United States Patent 12,097,253 (RSV RNA MOLECULES AND COMPOSITIONS FOR VACCINATION) - sequence listing, part 6

SEQ ID NO: 6569 - RNA, 1843 nt, synthetic construct
  misc_feature 1..1843: note = mRNA product Design d-1 comprising derived and/or modified sequence from HRSV(A2)__F-del_DSCav1_mut6 (opt11)
  source 1..1843: mol_type = other RNA
gggagacccgtgacccggaagttgtacggctacgcgactttccctcccacaaaccctcgcgcccttcctttcctacttgggcccggcagaaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6570 - RNA, 1898 nt, synthetic construct
  misc_feature 1..1898: note = mRNA product Design d-2 comprising derived and/or modified sequence from HRSV(A2)__F-del_DSCav1_mut6 (opt1)
  source 1..1898: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6571 - RNA, 1898 nt, synthetic construct
  misc_feature 1..1898: note = mRNA product Design d-2 comprising derived and/or modified sequence from HRSV(A2)__F-del_DSCav1_mut6 (opt1)
  source 1..1898: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6572 - RNA, 1898 nt, synthetic construct
  misc_feature 1..1898: note = mRNA product Design d-2 comprising derived and/or modified sequence from HRSV(A2)__F-del_DSCav1_mut6 (opt2)
  source 1..1898: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6573 - RNA, 1898 nt, synthetic construct
  misc_feature 1..1898: note = mRNA product Design d-2 comprising derived and/or modified sequence from HRSV(A2)__F-del_DSCav1_mut6 (opt3)
  source 1..1898: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6574 - RNA, 1898 nt, synthetic construct
  misc_feature 1..1898: note = mRNA product Design d-2 comprising derived and/or modified sequence from HRSV(A2)__F-del_DSCav1_mut6 (opt4)
  source 1..1898: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6575 - RNA, 1898 nt, synthetic construct
  misc_feature 1..1898: note = mRNA product Design d-2 comprising derived and/or modified sequence from HRSV(A2)__F-del_DSCav1_mut6 (opt5)
  source 1..1898: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6576 - RNA, 1898 nt, synthetic construct
  misc_feature 1..1898: note = mRNA product Design d-2 comprising derived and/or modified sequence from HRSV(A2)__F-del_DSCav1_mut6 (opt6)
  source 1..1898: mol_type = other RNA
gggagagcggctcggccattttgtcccagtcagtccggaggctgcggctgcagaagtaccgcctgcggagtaactgcaaagaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6577 - RNA, 1898 nt, synthetic construct
  misc_feature 1..1898: note = mRNA product Design d-2 comprising derived and/or modified sequence from HRSV(A2)__F-del_DSCav1_mut6 (opt11)
  source 1..1898: mol_type = other RNA
gggagagcggctcggccattttgtcccagtcagtccggaggctgcggctgcagaagtaccgcctgcggagtaactgcaaagaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6578 - RNA, 2214 nt, synthetic construct
  misc_feature 1..2214: note = mRNA product Design d-3 comprising derived and/or modified sequence from HRSV(A2)__F-del_DSCav1_mut6 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6579 - RNA, 2214 nt, synthetic construct
  misc_feature 1..2214: note = mRNA product Design d-3 comprising derived and/or modified sequence from HRSV(A2)__F-del_DSCav1_mut6 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6580 - RNA, 2214 nt, synthetic construct
  misc_feature 1..2214: note = mRNA product Design d-3 comprising derived and/or modified sequence from HRSV(A2)__F-del_DSCav1_mut6 (opt2)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6581 - RNA, 2214 nt, synthetic construct
  misc_feature 1..2214: note = mRNA product Design d-3 comprising derived and/or modified sequence from HRSV(A2)__F-del_DSCav1_mut6 (opt3)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6582 - RNA, 2214 nt, synthetic construct
  misc_feature 1..2214: note = mRNA product Design d-3 comprising derived and/or modified sequence from HRSV(A2)__F-del_DSCav1_mut6 (opt4)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6583 - RNA, 2214 nt, synthetic construct
  misc_feature 1..2214: note = mRNA product Design d-3 comprising derived and/or modified sequence from HRSV(A2)__F-del_DSCav1_mut6 (opt5)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6584 - RNA, 2214 nt, synthetic construct
  misc_feature 1..2214: note = mRNA product Design d-3 comprising derived and/or modified sequence from HRSV(A2)__F-del_DSCav1_mut6 (opt6)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6585 - RNA, 2214 nt, synthetic construct
  misc_feature 1..2214: note = mRNA product Design d-3 comprising derived and/or modified sequence from HRSV(A2)__F-del_DSCav1_mut6 (opt11)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6586 - RNA, 1897 nt, synthetic construct
  misc_feature 1..1897: note = mRNA product Design d-4 comprising derived and/or modified sequence from HRSV(A2)__F-del_DSCav1_mut6 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6587 - RNA, 1897 nt, synthetic construct
  misc_feature 1..1897: note = mRNA product Design d-4 comprising derived and/or modified sequence from HRSV(A2)__F-del_DSCav1_mut6 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6588 - RNA, 1897 nt, synthetic construct
  misc_feature 1..1897: note = mRNA product Design d-4 comprising derived and/or modified sequence from HRSV(A2)__F-del_DSCav1_mut6 (opt2)
  source 1..1897: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6589 - RNA, 1897 nt, synthetic construct
  misc_feature 1..1897: note = mRNA product Design d-4 comprising derived and/or modified sequence from HRSV(A2)__F-del_DSCav1_mut6 (opt3)
  source 1..1897: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6590 - RNA, 1897 nt, synthetic construct
  misc_feature 1..1897: note = mRNA product Design d-4 comprising derived and/or modified sequence from HRSV(A2)__F-del_DSCav1_mut6 (opt4)
  source 1..1897: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6591 - RNA, 1897 nt, synthetic construct
  misc_feature 1..1897: note = mRNA product Design d-4 comprising derived and/or modified sequence from HRSV(A2)__F-del_DSCav1_mut6 (opt5)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6592 - RNA, 1897 nt, synthetic construct
  misc_feature 1..1897: note = mRNA product Design d-4 comprising derived and/or modified sequence from HRSV(A2)__F-del_DSCav1_mut6 (opt6)
  source 1..1897: mol_type = other RNA
gggagagtcccgcagtcggcgtccagcggctctgcttgttcgtgtgtgtgtcgttgcaggccttattcaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6593 - RNA, 1897 nt, synthetic construct
  misc_feature 1..1897: note = mRNA product Design d-4 comprising derived and/or modified sequence from HRSV(A2)__F-del_DSCav1_mut6 (opt11)
  source 1..1897: mol_type = other RNA
gggagagtcccgcagtcggcgtccagcggctctgcttgttcgtgtgtgtgtcgttgcaggccttattcaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6594 - RNA, 1994 nt, synthetic construct
  misc_feature 1..1994: note = mRNA product Design d-5 comprising derived and/or modified sequence from HRSV(A2)__F-del_DSCav1_mut6 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6595 - RNA, 1994 nt, synthetic construct
  misc_feature 1..1994: note = mRNA product Design d-5 comprising derived and/or modified sequence from HRSV(A2)__F-del_DSCav1_mut6 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6596 - RNA, 1994 nt, synthetic construct
  misc_feature 1..1994: note = mRNA product Design d-5 comprising derived and/or modified sequence from HRSV(A2)__F-del_DSCav1_mut6 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6597 - RNA, 1994 nt, synthetic construct
  misc_feature 1..1994: note = mRNA product Design d-5 comprising derived and/or modified sequence from HRSV(A2)__F-del_DSCav1_mut6 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6598 - RNA, 1994 nt, synthetic construct
  misc_feature 1..1994: note = mRNA product Design d-5 comprising derived and/or modified sequence from HRSV(A2)__F-del_DSCav1_mut6 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6599 - RNA, 1994 nt, synthetic construct
  misc_feature 1..1994: note = mRNA product Design d-5 comprising derived and/or modified sequence from HRSV(A2)__F-del_DSCav1_mut6 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6600 - RNA, 1994 nt, synthetic construct
  misc_feature 1..1994: note = mRNA product Design d-5 comprising derived and/or modified sequence from HRSV(A2)__F-del_DSCav1_mut6 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6601 - RNA, 1994 nt, synthetic construct
  misc_feature 1..1994: note = mRNA product Design d-5 comprising derived and/or modified sequence from HRSV(A2)__F-del_DSCav1_mut6 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6602 - RNA, 1874 nt, synthetic construct
  misc_feature 1..1874: note = mRNA product Design e-1 comprising derived and/or modified sequence from HRSV(A2)__F-del_DSCav1_mut6 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6603 - RNA, 1874 nt, synthetic construct
  misc_feature 1..1874: note = mRNA product Design e-1 comprising derived and/or modified sequence from HRSV(A2)__F-del_DSCav1_mut6 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6604 - RNA, 1874 nt, synthetic construct
  misc_feature 1..1874: note = mRNA product Design e-1 comprising derived and/or modified sequence from HRSV(A2)__F-del_DSCav1_mut6 (opt2)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6605 - RNA, 1874 nt, synthetic construct
  misc_feature 1..1874: note = mRNA product Design e-1 comprising derived and/or modified sequence from HRSV(A2)__F-del_DSCav1_mut6 (opt3)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6606 - RNA, 1874 nt, synthetic construct
  misc_feature 1..1874: note = mRNA product Design e-1 comprising derived and/or modified sequence from HRSV(A2)__F-del_DSCav1_mut6 (opt4)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6607 - RNA, 1874 nt, synthetic construct
  misc_feature 1..1874: note = mRNA product Design e-1 comprising derived and/or modified sequence from HRSV(A2)__F-del_DSCav1_mut6 (opt5)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6608 - RNA, 1874 nt, synthetic construct
  misc_feature 1..1874: note = mRNA product Design e-1 comprising derived and/or modified sequence from HRSV(A2)__F-del_DSCav1_mut6 (opt6)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6609 - RNA, 1874 nt, synthetic construct
  misc_feature 1..1874: note = mRNA product Design e-1 comprising derived and/or modified sequence from HRSV(A2)__F-del_DSCav1_mut6 (opt11)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6610 - RNA, 1856 nt, synthetic construct
  misc_feature 1..1856: note = mRNA product Design e-2 comprising derived and/or modified sequence from HRSV(A2)__F-del_DSCav1_mut6 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6611 - RNA, 1856 nt, synthetic construct
  misc_feature 1..1856: note = mRNA product Design e-2 comprising derived and/or modified sequence from HRSV(A2)__F-del_DSCav1_mut6 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6612 - RNA, 1856 nt, synthetic construct
  misc_feature 1..1856: note = mRNA product Design e-2 comprising derived and/or modified sequence from HRSV(A2)__F-del_DSCav1_mut6 (opt2)
  source 1..1856: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6613 - RNA, 1856 nt, synthetic construct
  misc_feature 1..1856: note = mRNA product Design e-2 comprising derived and/or modified sequence from HRSV(A2)__F-del_DSCav1_mut6 (opt3)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6614 - RNA, 1856 nt, synthetic construct
  misc_feature 1..1856: note = mRNA product Design e-2 comprising derived and/or modified sequence from HRSV(A2)__F-del_DSCav1_mut6 (opt4)
  source 1..1856: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6615 - RNA, 1856 nt, synthetic construct
  misc_feature 1..1856: note = mRNA product Design e-2 comprising derived and/or modified sequence from HRSV(A2)__F-del_DSCav1_mut6 (opt5)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6616 - RNA, 1856 nt, synthetic construct
  misc_feature 1..1856: note = mRNA product Design e-2 comprising derived and/or modified sequence from HRSV(A2)__F-del_DSCav1_mut6 (opt6)
  source 1..1856: mol_type = other RNA
gggagacccgtgacccggaagttgtacggctacgcgactttccctcccacaaaccctcgcgcccttcctttcctacttgggcccggcagaaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6617 - RNA, 1856 nt, synthetic construct
  misc_feature 1..1856: note = mRNA product Design e-2 comprising derived and/or modified sequence from HRSV(A2)__F-del_DSCav1_mut6 (opt11)
  source 1..1856: mol_type = other RNA
gggagacccgtgacccggaagttgtacggctacgcgactttccctcccacaaaccctcgcgcccttcctttcctacttgggcccggcagaaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6618 - RNA, 1826 nt, synthetic construct
  misc_feature 1..1826: note = mRNA product Design e-3 comprising derived and/or modified sequence from HRSV(A2)__F-del_DSCav1_mut6 (opt1)
  source 1..1826: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6619 - RNA, 1826 nt, synthetic construct
  misc_feature 1..1826: note = mRNA product Design e-3 comprising derived and/or modified sequence from HRSV(A2)__F-del_DSCav1_mut6 (opt1)
  source 1..1826: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6620 - RNA, 1826 nt, synthetic construct
  misc_feature 1..1826: note = mRNA product Design e-3 comprising derived and/or modified sequence from HRSV(A2)__F-del_DSCav1_mut6 (opt2)
  source 1..1826: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6621 - RNA, 1826 nt, synthetic construct
  misc_feature 1..1826: note = mRNA product Design e-3 comprising derived and/or modified sequence from HRSV(A2)__F-del_DSCav1_mut6 (opt3)
  source 1..1826: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6622 - RNA, 1826 nt, synthetic construct
  misc_feature 1..1826: note = mRNA product Design e-3 comprising derived and/or modified sequence from HRSV(A2)__F-del_DSCav1_mut6 (opt4)
  source 1..1826: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6623 - RNA, 1826 nt, synthetic construct
  misc_feature 1..1826: note = mRNA product Design e-3 comprising derived and/or modified sequence from HRSV(A2)__F-del_DSCav1_mut6 (opt5)
  source 1..1826: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6624 - RNA, 1826 nt, synthetic construct
  misc_feature 1..1826: note = mRNA product Design e-3 comprising derived and/or modified sequence from HRSV(A2)__F-del_DSCav1_mut6 (opt6)
  source 1..1826: mol_type = other RNA
gggagactttcccattctgtagcagaatttggtgttgcctgtggtcttggtcccgcggagaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6625 - RNA, 1826 nt, synthetic construct
  misc_feature 1..1826: note = mRNA product Design e-3 comprising derived and/or modified sequence from HRSV(A2)__F-del_DSCav1_mut6 (opt11)
  source 1..1826: mol_type = other RNA
gggagactttcccattctgtagcagaatttggtgttgcctgtggtcttggtcccgcggagaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6626 - RNA, 1880 nt, synthetic construct
  misc_feature 1..1880: note = mRNA product Design e-4 comprising derived and/or modified sequence from HRSV(A2)__F-del_DSCav1_mut6 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6627 - RNA, 1880 nt, synthetic construct
  misc_feature 1..1880: note = mRNA product Design e-4 comprising derived and/or modified sequence from HRSV(A2)__F-del_DSCav1_mut6 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6628 - RNA, 1880 nt, synthetic construct
  misc_feature 1..1880: note = mRNA product Design e-4 comprising derived and/or modified sequence from HRSV(A2)__F-del_DSCav1_mut6 (opt2)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6629 - RNA, 1880 nt, synthetic construct
  misc_feature 1..1880: note = mRNA product Design e-4 comprising derived and/or modified sequence from HRSV(A2)__F-del_DSCav1_mut6 (opt3)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6630 - RNA, 1880 nt, synthetic construct
  misc_feature 1..1880: note = mRNA product Design e-4 comprising derived and/or modified sequence from HRSV(A2)__F-del_DSCav1_mut6 (opt4)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6631 - RNA, 1880 nt, synthetic construct
  misc_feature 1..1880: note = mRNA product Design e-4 comprising derived and/or modified sequence from HRSV(A2)__F-del_DSCav1_mut6 (opt5)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6632 - RNA, 1880 nt, synthetic construct
  misc_feature 1..1880: note = mRNA product Design e-4 comprising derived and/or modified sequence from HRSV(A2)__F-del_DSCav1_mut6 (opt6)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6633 - RNA, 1880 nt, synthetic construct
  misc_feature 1..1880: note = mRNA product Design e-4 comprising derived and/or modified sequence from HRSV(A2)__F-del_DSCav1_mut6 (opt11)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6634 - RNA, 1847 nt, synthetic construct
  misc_feature 1..1847: note = mRNA product Design e-5 comprising derived and/or modified sequence from HRSV(A2)__F-del_DSCav1_mut6 (opt1)
  source 1..1847: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6635 - RNA, 1847 nt, synthetic construct
  misc_feature 1..1847: note = mRNA product Design e-5 comprising derived and/or modified sequence from HRSV(A2)__F-del_DSCav1_mut6 (opt1)
  source 1..1847: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6636 - RNA, 1847 nt, synthetic construct
  misc_feature 1..1847: note = mRNA product Design e-5 comprising derived and/or modified sequence from HRSV(A2)__F-del_DSCav1_mut6 (opt2)
  source 1..1847: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6637 - RNA, 1847 nt, synthetic construct
  misc_feature 1..1847: note = mRNA product Design e-5 comprising derived and/or modified sequence from HRSV(A2)__F-del_DSCav1_mut6 (opt3)
  source 1..1847: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6638 - RNA, 1847 nt, synthetic construct
  misc_feature 1..1847: note = mRNA product Design e-5 comprising derived and/or modified sequence from HRSV(A2)__F-del_DSCav1_mut6 (opt4)
  source 1..1847: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6639 - RNA, 1847 nt, synthetic construct
  misc_feature 1..1847: note = mRNA product Design e-5 comprising derived and/or modified sequence from HRSV(A2)__F-del_DSCav1_mut6 (opt5)
  source 1..1847: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6640 - RNA, 1847 nt, synthetic construct
  misc_feature 1..1847: note = mRNA product Design e-5 comprising derived and/or modified sequence from HRSV(A2)__F-del_DSCav1_mut6 (opt6)
  source 1..1847: mol_type = other RNA
gggagagcggctcggccattttgtcccagtcagtccggaggctgcggctgcagaagtaccgcctgcggagtaactgcaaagaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6641 - RNA, 1847 nt, synthetic construct
  misc_feature 1..1847: note = mRNA product Design e-5 comprising derived and/or modified sequence from HRSV(A2)__F-del_DSCav1_mut6 (opt11)
  source 1..1847: mol_type = other RNA
gggagagcggctcggccattttgtcccagtcagtccggaggctgcggctgcagaagtaccgcctgcggagtaactgcaaagaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6642 - RNA, 1914 nt, synthetic construct
  misc_feature 1..1914: note = mRNA product Design e-6 comprising derived and/or modified sequence from HRSV(A2)__F-del_DSCav1_mut6 (opt1)
  source 1..1914: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6643 - RNA, 1914 nt, synthetic construct
  misc_feature 1..1914: note = mRNA product Design e-6 comprising derived and/or modified sequence from HRSV(A2)__F-del_DSCav1_mut6 (opt1)
  source 1..1914: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6644 - RNA, 1914 nt, synthetic construct
  misc_feature 1..1914: note = mRNA product Design e-6 comprising derived and/or modified sequence from HRSV(A2)__F-del_DSCav1_mut6 (opt2)
  source 1..1914: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6645 - RNA, 1914 nt, synthetic construct
  misc_feature 1..1914: note = mRNA product Design e-6 comprising derived and/or modified sequence from HRSV(A2)__F-del_DSCav1_mut6 (opt3)
  source 1..1914: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6646 - RNA, 1914 nt, synthetic construct
  misc_feature 1..1914: note = mRNA product Design e-6 comprising derived and/or modified sequence from HRSV(A2)__F-del_DSCav1_mut6 (opt4)
  source 1..1914: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6647 - RNA, 1914 nt, synthetic construct
  misc_feature 1..1914: note = mRNA product Design e-6 comprising derived and/or modified sequence from HRSV(A2)__F-del_DSCav1_mut6 (opt5)
  source 1..1914: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6648 - RNA, 1914 nt, synthetic construct
  misc_feature 1..1914: note = mRNA product Design e-6 comprising derived and/or modified sequence from HRSV(A2)__F-del_DSCav1_mut6 (opt6)
  source 1..1914: mol_type = other RNA
gggagagcggctcggccattttgtcccagtcagtccggaggctgcggctgcagaagtaccgcctgcggagtaactgcaaagaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6649 - RNA, 1914 nt, synthetic construct
  misc_feature 1..1914: note = mRNA product Design e-6 comprising derived and/or modified sequence from HRSV(A2)__F-del_DSCav1_mut6 (opt11)
  source 1..1914: mol_type = other RNA
gggagagcggctcggccattttgtcccagtcagtccggaggctgcggctgcagaagtaccgcctgcggagtaactgcaaagaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6650 - RNA, 2130 nt, synthetic construct
  misc_feature 1..2130: note = mRNA product Design f-1 comprising derived and/or modified sequence from HRSV(A2)__F-del_DSCav1_mut6 (opt1)
  source 1..2130: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6651 - RNA, 2130 nt, synthetic construct
  misc_feature 1..2130: note = mRNA product Design f-1 comprising derived and/or modified sequence from HRSV(A2)__F-del_DSCav1_mut6 (opt1)
  source 1..2130: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6652 - RNA, 2130 nt, synthetic construct
  misc_feature 1..2130: note = mRNA product Design f-1 comprising derived and/or modified sequence from HRSV(A2)__F-del_DSCav1_mut6 (opt2)
  source 1..2130: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6653 - RNA, 2130 nt, synthetic construct
  misc_feature 1..2130: note = mRNA product Design f-1 comprising derived and/or modified sequence from HRSV(A2)__F-del_DSCav1_mut6 (opt3)
  source 1..2130: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6654 - RNA, 2130 nt, synthetic construct
  misc_feature 1..2130: note = mRNA product Design f-1 comprising derived and/or modified sequence from HRSV(A2)__F-del_DSCav1_mut6 (opt4)
  source 1..2130: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6655 - RNA, 2130 nt, synthetic construct
  misc_feature 1..2130: note = mRNA product Design f-1 comprising derived and/or modified sequence from HRSV(A2)__F-del_DSCav1_mut6 (opt5)
  source 1..2130: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6656 - RNA, 2130 nt, synthetic construct
  misc_feature 1..2130: note = mRNA product Design f-1 comprising derived and/or modified sequence from HRSV(A2)__F-del_DSCav1_mut6 (opt6)
  source 1..2130: mol_type = other RNA
gggagagcggctcggccattttgtcccagtcagtccggaggctgcggctgcagaagtaccgcctgcggagtaactgcaaagaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6657 - RNA, 2130 nt, synthetic construct
  misc_feature 1..2130: note = mRNA product Design f-1 comprising derived and/or modified sequence from HRSV(A2)__F-del_DSCav1_mut6 (opt11)
  source 1..2130: mol_type = other RNA
gggagagcggctcggccattttgtcccagtcagtccggaggctgcggctgcagaagtaccgcctgcggagtaactgcaaagaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6658 - RNA, 1910 nt, synthetic construct
  misc_feature 1..1910: note = mRNA product Design f-2 comprising derived and/or modified sequence from HRSV(A2)__F-del_DSCav1_mut6 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6659 - RNA, 1910 nt, synthetic construct
  misc_feature 1..1910: note = mRNA product Design f-2 comprising derived and/or modified sequence from HRSV(A2)__F-del_DSCav1_mut6 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6660 - RNA, 1910 nt, synthetic construct
  misc_feature 1..1910: note = mRNA product Design f-2 comprising derived and/or modified sequence from HRSV(A2)__F-del_DSCav1_mut6 (opt2)
  source 1..1910: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6661 - RNA, 1910 nt, synthetic construct
  misc_feature 1..1910: note = mRNA product Design f-2 comprising derived and/or modified sequence from HRSV(A2)__F-del_DSCav1_mut6 (opt3)
  source 1..1910: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6662 - RNA, 1910 nt, synthetic construct
  misc_feature 1..1910: note = mRNA product Design f-2 comprising derived and/or modified sequence from HRSV(A2)__F-del_DSCav1_mut6 (opt4)
  source 1..1910: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6663 - RNA, 1910 nt, synthetic construct
  misc_feature 1..1910: note = mRNA product Design f-2 comprising derived and/or modified sequence from HRSV(A2)__F-del_DSCav1_mut6 (opt5)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6664 - RNA, 1910 nt, synthetic construct
  misc_feature 1..1910: note = mRNA product Design f-2 comprising derived and/or modified sequence from HRSV(A2)__F-del_DSCav1_mut6 (opt6)
  source 1..1910: mol_type = other RNA
gggagagcggctcggccattttgtcccagtcagtccggaggctgcggctgcagaagtaccgcctgcggagtaactgcaaagaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6665 - RNA, 1910 nt, synthetic construct
  misc_feature 1..1910: note = mRNA product Design f-2 comprising derived and/or modified sequence from HRSV(A2)__F-del_DSCav1_mut6 (opt11)
  source 1..1910: mol_type = other RNA
gggagagcggctcggccattttgtcccagtcagtccggaggctgcggctgcagaagtaccgcctgcggagtaactgcaaagaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6666 - RNA, 1901 nt, synthetic construct
  misc_feature 1..1901: note = mRNA product Design f-3 comprising derived and/or modified sequence from HRSV(A2)__F-del_DSCav1_mut6 (opt1)
  source 1..1901: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6667 - RNA, 1901 nt, synthetic construct
  misc_feature 1..1901: note = mRNA product Design f-3 comprising derived and/or modified sequence from HRSV(A2)__F-del_DSCav1_mut6 (opt1)
  source 1..1901: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6668 - RNA, 1901 nt, synthetic construct
  misc_feature 1..1901: note = mRNA product Design f-3 comprising derived and/or modified sequence from HRSV(A2)__F-del_DSCav1_mut6 (opt2)
  source 1..1901: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6669 - RNA, 1901 nt, synthetic construct
  misc_feature 1..1901: note = mRNA product Design f-3 comprising derived and/or modified sequence from HRSV(A2)__F-del_DSCav1_mut6 (opt3)
  source 1..1901: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6670 - RNA, 1901 nt, synthetic construct
  misc_feature 1..1901: note = mRNA product Design f-3 comprising derived and/or modified sequence from HRSV(A2)__F-del_DSCav1_mut6 (opt4)
  source 1..1901: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6671 - RNA, 1901 nt, synthetic construct
  misc_feature 1..1901: note = mRNA product Design f-3 comprising derived and/or modified sequence from HRSV(A2)__F-del_DSCav1_mut6 (opt5)
  source 1..1901: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6672 - RNA, 1901 nt, synthetic construct
  misc_feature 1..1901: note = mRNA product Design f-3 comprising derived and/or modified sequence from HRSV(A2)__F-del_DSCav1_mut6 (opt6)
  source 1..1901: mol_type = other RNA
gggagagtcccgcagtcggcgtccagcggctctgcttgttcgtgtgtgtgtcgttgcaggccttattcaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6673 - RNA, 1901 nt, synthetic construct
  misc_feature 1..1901: note = mRNA product Design f-3 comprising derived and/or modified sequence from HRSV(A2)__F-del_DSCav1_mut6 (opt11)
  source 1..1901: mol_type = other RNA
gggagagtcccgcagtcggcgtccagcggctctgcttgttcgtgtgtgtgtcgttgcaggccttattcaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6674 - RNA, 2117 nt, synthetic construct
  misc_feature 1..2117: note = mRNA product Design f-4 comprising derived and/or modified sequence from HRSV(A2)__F-del_DSCav1_mut6 (opt1)
  source 1..2117: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6675 - RNA, 2117 nt, synthetic construct
  misc_feature 1..2117: note = mRNA product Design f-4 comprising derived and/or modified sequence from HRSV(A2)__F-del_DSCav1_mut6 (opt1)
  source 1..2117: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6676 - RNA, 2117 nt, synthetic construct
  misc_feature 1..2117: note = mRNA product Design f-4 comprising derived and/or modified sequence from HRSV(A2)__F-del_DSCav1_mut6 (opt2)
  source 1..2117: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6677 - RNA, 2117 nt, synthetic construct
  misc_feature 1..2117: note = mRNA product Design f-4 comprising derived and/or modified sequence from HRSV(A2)__F-del_DSCav1_mut6 (opt3)
  source 1..2117: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6678 - RNA, 2117 nt, synthetic construct
  misc_feature 1..2117: note = mRNA product Design f-4 comprising derived and/or modified sequence from HRSV(A2)__F-del_DSCav1_mut6 (opt4)
  source 1..2117: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6679 - RNA, 2117 nt, synthetic construct
  misc_feature 1..2117: note = mRNA product Design f-4 comprising derived and/or modified sequence from HRSV(A2)__F-del_DSCav1_mut6 (opt5)
  source 1..2117: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6680 - RNA, 2117 nt, synthetic construct
  misc_feature 1..2117: note = mRNA product Design f-4 comprising derived and/or modified sequence from HRSV(A2)__F-del_DSCav1_mut6 (opt6)
  source 1..2117: mol_type = other RNA
gggagagtcccgcagtcggcgtccagcggctctgcttgttcgtgtgtgtgtcgttgcaggccttattcaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6681 - RNA, 2117 nt, synthetic construct
  misc_feature 1..2117: note = mRNA product Design f-4 comprising derived and/or modified sequence from HRSV(A2)__F-del_DSCav1_mut6 (opt11)
  source 1..2117: mol_type = other RNA
gggagagtcccgcagtcggcgtccagcggctctgcttgttcgtgtgtgtgtcgttgcaggccttattcaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6682 - RNA, 1893 nt, synthetic construct
  misc_feature 1..1893: note = mRNA product Design f-5 comprising derived and/or modified sequence from HRSV(A2)__F-del_DSCav1_mut6 (opt1)
  source 1..1893: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6683 - RNA, 1893 nt, synthetic construct
  misc_feature 1..1893: note = mRNA product Design f-5 comprising derived and/or modified sequence from HRSV(A2)__F-del_DSCav1_mut6 (opt1)
  source 1..1893: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6684 - RNA, 1893 nt, synthetic construct
  misc_feature 1..1893: note = mRNA product Design f-5 comprising derived and/or modified sequence from HRSV(A2)__F-del_DSCav1_mut6 (opt2)
  source 1..1893: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6685 - RNA, 1893 nt, synthetic construct
  misc_feature 1..1893: note = mRNA product Design f-5 comprising derived and/or modified sequence from HRSV(A2)__F-del_DSCav1_mut6 (opt3)
  source 1..1893: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6686 - RNA, 1893 nt, synthetic construct
  misc_feature 1..1893: note = mRNA product Design f-5 comprising derived and/or modified sequence from HRSV(A2)__F-del_DSCav1_mut6 (opt4)
  source 1..1893: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6687 - RNA, 1893 nt, synthetic construct
  misc_feature 1..1893: note = mRNA product Design f-5 comprising derived and/or modified sequence from HRSV(A2)__F-del_DSCav1_mut6 (opt5)
  source 1..1893: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6688 - RNA, 1893 nt, synthetic construct
  misc_feature 1..1893: note = mRNA product Design f-5 comprising derived and/or modified sequence from HRSV(A2)__F-del_DSCav1_mut6 (opt6)
  source 1..1893: mol_type = other RNA
gggagactttcccattctgtagcagaatttggtgttgcctgtggtcttggtcccgcggagaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6689 - RNA, 1893 nt, synthetic construct
  misc_feature 1..1893: note = mRNA product Design f-5 comprising derived and/or modified sequence from HRSV(A2)__F-del_DSCav1_mut6 (opt11)
  source 1..1893: mol_type = other RNA
gggagactttcccattctgtagcagaatttggtgttgcctgtggtcttggtcccgcggagaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6690 - RNA, 1889 nt, synthetic construct
  misc_feature 1..1889: note = mRNA product Design g-1 comprising derived and/or modified sequence from HRSV(A2)__F-del_DSCav1_mut6 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6691 - RNA, 1889 nt, synthetic construct
  misc_feature 1..1889: note = mRNA product Design g-1 comprising derived and/or modified sequence from HRSV(A2)__F-del_DSCav1_mut6 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6692 - RNA, 1889 nt, synthetic construct
  misc_feature 1..1889: note = mRNA product Design g-1 comprising derived and/or modified sequence from HRSV(A2)__F-del_DSCav1_mut6 (opt2)
  source 1..1889: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6693 - RNA, 1889 nt, synthetic construct
  misc_feature 1..1889: note = mRNA product Design g-1 comprising derived and/or modified sequence from HRSV(A2)__F-del_DSCav1_mut6 (opt3)
  source 1..1889: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6694 - RNA, 1889 nt, synthetic construct
  misc_feature 1..1889: note = mRNA product Design g-1 comprising derived and/or modified sequence from HRSV(A2)__F-del_DSCav1_mut6 (opt4)
  source 1..1889: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6695 - RNA, 1889 nt, synthetic construct
  misc_feature 1..1889: note = mRNA product Design g-1 comprising derived and/or modified sequence from HRSV(A2)__F-del_DSCav1_mut6 (opt5)
  source 1..1889: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6696 - RNA, 1889 nt, synthetic construct
  misc_feature 1..1889: note = mRNA product Design g-1 comprising derived and/or modified sequence from HRSV(A2)__F-del_DSCav1_mut6 (opt6)
  source 1..1889: mol_type = other RNA
gggagactttcccattctgtagcagaatttggtgttgcctgtggtcttggtcccgcggagaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6697 - RNA, 1889 nt, synthetic construct
  misc_feature 1..1889: note = mRNA product Design g-1 comprising derived and/or modified sequence from HRSV(A2)__F-del_DSCav1_mut6 (opt11)
  source 1..1889: mol_type = other RNA
gggagactttcccattctgtagcagaatttggtgttgcctgtggtcttggtcccgcggagaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6698 - RNA, 1904 nt, synthetic construct
  misc_feature 1..1904: note = mRNA product Design g-2 comprising derived and/or modified sequence from HRSV(A2)__F-del_DSCav1_mut6 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6699 - RNA, 1904 nt, synthetic construct
  misc_feature 1..1904: note = mRNA product Design g-2 comprising derived and/or modified sequence from HRSV(A2)__F-del_DSCav1_mut6 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6700 - RNA, 1904 nt, synthetic construct
  misc_feature 1..1904: note = mRNA product Design g-2 comprising derived and/or modified sequence from HRSV(A2)__F-del_DSCav1_mut6 (opt2)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6701 - RNA, 1904 nt, synthetic construct
  misc_feature 1..1904: note = mRNA product Design g-2 comprising derived and/or modified sequence from HRSV(A2)__F-del_DSCav1_mut6 (opt3)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6702 - RNA, 1904 nt, synthetic construct
  misc_feature 1..1904: note = mRNA product Design g-2 comprising derived and/or modified sequence from HRSV(A2)__F-del_DSCav1_mut6 (opt4)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6703 - RNA, 1904 nt, synthetic construct
  misc_feature 1..1904: note = mRNA product Design g-2 comprising derived and/or modified sequence from HRSV(A2)__F-del_DSCav1_mut6 (opt5)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6704 - RNA, 1904 nt, synthetic construct
  misc_feature 1..1904: note = mRNA product Design g-2 comprising derived and/or modified sequence from HRSV(A2)__F-del_DSCav1_mut6 (opt6)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6705 - RNA, 1904 nt, synthetic construct
  misc_feature 1..1904: note = mRNA product Design g-2 comprising derived and/or modified sequence from HRSV(A2)__F-del_DSCav1_mut6 (opt11)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6706 - RNA, 2136 nt, synthetic construct
  misc_feature 1..2136: note = mRNA product Design g-3 comprising derived and/or modified sequence from HRSV(A2)__F-del_DSCav1_mut6 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6707 - RNA, 2136 nt, synthetic construct
  misc_feature 1..2136: note = mRNA product Design g-3 comprising derived and/or modified sequence from HRSV(A2)__F-del_DSCav1_mut6 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6708 - RNA, 2136 nt, synthetic construct
  misc_feature 1..2136: note = mRNA product Design g-3 comprising derived and/or modified sequence from HRSV(A2)__F-del_DSCav1_mut6 (opt2)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6709 - RNA, 2136 nt, synthetic construct
  misc_feature 1..2136: note = mRNA product Design g-3 comprising derived and/or modified sequence from HRSV(A2)__F-del_DSCav1_mut6 (opt3)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6710 - RNA, 2136 nt, synthetic construct
  misc_feature 1..2136: note = mRNA product Design g-3 comprising derived and/or modified sequence from HRSV(A2)__F-del_DSCav1_mut6 (opt4)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6711 - RNA, 2136 nt, synthetic construct
  misc_feature 1..2136: note = mRNA product Design g-3 comprising derived and/or modified sequence from HRSV(A2)__F-del_DSCav1_mut6 (opt5)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6712 - RNA, 2136 nt, synthetic construct
  misc_feature 1..2136: note = mRNA product Design g-3 comprising derived and/or modified sequence from HRSV(A2)__F-del_DSCav1_mut6 (opt6)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6713 - RNA, 2136 nt, synthetic construct
  misc_feature 1..2136: note = mRNA product Design g-3 comprising derived and/or modified sequence from HRSV(A2)__F-del_DSCav1_mut6 (opt11)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6714 - RNA, 1931 nt, synthetic construct
  misc_feature 1..1931: note = mRNA product Design g-4 comprising derived and/or modified sequence from HRSV(A2)__F-del_DSCav1_mut6 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6715 - RNA, 1931 nt, synthetic construct
  misc_feature 1..1931: note = mRNA product Design g-4 comprising derived and/or modified sequence from HRSV(A2)__F-del_DSCav1_mut6 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6716 - RNA, 1931 nt, synthetic construct
  misc_feature 1..1931: note = mRNA product Design g-4 comprising derived and/or modified sequence from HRSV(A2)__F-del_DSCav1_mut6 (opt2)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6717 - RNA, 1931 nt, synthetic construct
  misc_feature 1..1931: note = mRNA product Design g-4 comprising derived and/or modified sequence from HRSV(A2)__F-del_DSCav1_mut6 (opt3)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6718 - RNA, 1931 nt, synthetic construct
  misc_feature 1..1931: note = mRNA product Design g-4 comprising derived and/or modified sequence from HRSV(A2)__F-del_DSCav1_mut6 (opt4)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6719 - RNA, 1931 nt, synthetic construct
  misc_feature 1..1931: note = mRNA product Design g-4 comprising derived and/or modified sequence from HRSV(A2)__F-del_DSCav1_mut6 (opt5)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6720 - RNA, 1931 nt, synthetic construct
  misc_feature 1..1931: note = mRNA product Design g-4 comprising derived and/or modified sequence from HRSV(A2)__F-del_DSCav1_mut6 (opt6)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6721 - RNA, 1931 nt, synthetic construct
  misc_feature 1..1931: note = mRNA product Design g-4 comprising derived and/or modified sequence from HRSV(A2)__F-del_DSCav1_mut6 (opt11)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6722 - RNA, 1907 nt, synthetic construct
  misc_feature 1..1907: note = mRNA product Design g-5 comprising derived and/or modified sequence from HRSV(A2)__F-del_DSCav1_mut6 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6723 - RNA, 1907 nt, synthetic construct
  misc_feature 1..1907: note = mRNA product Design g-5 comprising derived and/or modified sequence from HRSV(A2)__F-del_DSCav1_mut6 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6724 - RNA, 1907 nt, synthetic construct
  misc_feature 1..1907: note = mRNA product Design g-5 comprising derived and/or modified sequence from HRSV(A2)__F-del_DSCav1_mut6 (opt2)
  source 1..1907: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6725 - RNA, 1907 nt, synthetic construct
  misc_feature 1..1907: note = mRNA product Design g-5 comprising derived and/or modified sequence from HRSV(A2)__F-del_DSCav1_mut6 (opt3)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6726 - RNA, 1907 nt, synthetic construct
  misc_feature 1..1907: note = mRNA product Design g-5 comprising derived and/or modified sequence from HRSV(A2)__F-del_DSCav1_mut6 (opt4)
  source 1..1907: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6727 - RNA, 1907 nt, synthetic construct
  misc_feature 1..1907: note = mRNA product Design g-5 comprising derived and/or modified sequence from HRSV(A2)__F-del_DSCav1_mut6 (opt5)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6728 - RNA, 1907 nt, synthetic construct
  misc_feature 1..1907: note = mRNA product Design g-5 comprising derived and/or modified sequence from HRSV(A2)__F-del_DSCav1_mut6 (opt6)
  source 1..1907: mol_type = other RNA
gggagacccgtgacccggaagttgtacggctacgcgactttccctcccacaaaccctcgcgcccttcctttcctacttgggcccggcagaaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6729 - RNA, 1907 nt, synthetic construct
  misc_feature 1..1907: note = mRNA product Design g-5 comprising derived and/or modified sequence from HRSV(A2)__F-del_DSCav1_mut6 (opt11)
  source 1..1907: mol_type = other RNA
gggagacccgtgacccggaagttgtacggctacgcgactttccctcccacaaaccctcgcgcccttcctttcctacttgggcccggcagaaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6730 - RNA, 1923 nt, synthetic construct
  misc_feature 1..1923: note = mRNA product Design h-1 comprising derived and/or modified sequence from HRSV(A2)__F-del_DSCav1_mut6 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6731 - RNA, 1923 nt, synthetic construct
  misc_feature 1..1923: note = mRNA product Design h-1 comprising derived and/or modified sequence from HRSV(A2)__F-del_DSCav1_mut6 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6732 - RNA, 1923 nt, synthetic construct
  misc_feature 1..1923: note = mRNA product Design h-1 comprising derived and/or modified sequence from HRSV(A2)__F-del_DSCav1_mut6 (opt2)
  source 1..1923: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6733 - RNA, 1923 nt, synthetic construct
  misc_feature 1..1923: note = mRNA product Design h-1 comprising derived and/or modified sequence from HRSV(A2)__F-del_DSCav1_mut6 (opt3)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6734 - RNA, 1923 nt, synthetic construct
  misc_feature 1..1923: note = mRNA product Design h-1 comprising derived and/or modified sequence from HRSV(A2)__F-del_DSCav1_mut6 (opt4)
  source 1..1923: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6735 - RNA, 1923 nt, synthetic construct
  misc_feature 1..1923: note = mRNA product Design h-1 comprising derived and/or modified sequence from HRSV(A2)__F-del_DSCav1_mut6 (opt5)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6736 - RNA, 1923 nt, synthetic construct
  misc_feature 1..1923: note = mRNA product Design h-1 comprising derived and/or modified sequence from HRSV(A2)__F-del_DSCav1_mut6 (opt6)
  source 1..1923: mol_type = other RNA
gggagacccgtgacccggaagttgtacggctacgcgactttccctcccacaaaccctcgcgcccttcctttcctacttgggcccggcagaaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6737 - RNA, 1923 nt, synthetic construct
  misc_feature 1..1923: note = mRNA product Design h-1 comprising derived and/or modified sequence from HRSV(A2)__F-del_DSCav1_mut6 (opt11)
  source 1..1923: mol_type = other RNA
gggagacccgtgacccggaagttgtacggctacgcgactttccctcccacaaaccctcgcgcccttcctttcctacttgggcccggcagaaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6738 - RNA, 2139 nt, synthetic construct
  misc_feature 1..2139: note = mRNA product Design h-2 comprising derived and/or modified sequence from HRSV(A2)__F-del_DSCav1_mut6 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6739 - RNA, 2139 nt, synthetic construct
  misc_feature 1..2139: note = mRNA product Design h-2 comprising derived and/or modified sequence from HRSV(A2)__F-del_DSCav1_mut6 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6740 - RNA, 2139 nt, synthetic construct
  misc_feature 1..2139: note = mRNA product Design h-2 comprising derived and/or modified sequence from HRSV(A2)__F-del_DSCav1_mut6 (opt2)
  source 1..2139: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6741 - RNA, 2139 nt, synthetic construct
  misc_feature 1..2139: note = mRNA product Design h-2 comprising derived and/or modified sequence from HRSV(A2)__F-del_DSCav1_mut6 (opt3)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6742 - RNA, 2139 nt, synthetic construct
  misc_feature 1..2139: note = mRNA product Design h-2 comprising derived and/or modified sequence from HRSV(A2)__F-del_DSCav1_mut6 (opt4)
  source 1..2139: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6743 - RNA, 2139 nt, synthetic construct
  misc_feature 1..2139: note = mRNA product Design h-2 comprising derived and/or modified sequence from HRSV(A2)__F-del_DSCav1_mut6 (opt5)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6744 - RNA, 2139 nt, synthetic construct
  misc_feature 1..2139: note = mRNA product Design h-2 comprising derived and/or modified sequence from HRSV(A2)__F-del_DSCav1_mut6 (opt6)
  source 1..2139: mol_type = other RNA
gggagacccgtgacccggaagttgtacggctacgcgactttccctcccacaaaccctcgcgcccttcctttcctacttgggcccggcagaaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6745 - RNA, 2139 nt, synthetic construct
  misc_feature 1..2139: note = mRNA product Design h-2 comprising derived and/or modified sequence from HRSV(A2)__F-del_DSCav1_mut6 (opt11)
  source 1..2139: mol_type = other RNA
gggagacccgtgacccggaagttgtacggctacgcgactttccctcccacaaaccctcgcgcccttcctttcctacttgggcccggcagaaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6746 - RNA, 1919 nt, synthetic construct
  misc_feature 1..1919: note = mRNA product Design h-3 comprising derived and/or modified sequence from HRSV(A2)__F-del_DSCav1_mut6 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6747 - RNA, 1919 nt, synthetic construct
  misc_feature 1..1919: note = mRNA product Design h-3 comprising derived and/or modified sequence from HRSV(A2)__F-del_DSCav1_mut6 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6748 - RNA, 1919 nt, synthetic construct
  misc_feature 1..1919: note = mRNA product Design h-3 comprising derived and/or modified sequence from HRSV(A2)__F-del_DSCav1_mut6 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6749 - RNA, 1919 nt, synthetic construct
  misc_feature 1..1919: note = mRNA product Design h-3 comprising derived and/or modified sequence from HRSV(A2)__F-del_DSCav1_mut6 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6750 - RNA, 1919 nt, synthetic construct
  misc_feature 1..1919: note = mRNA product Design h-3 comprising derived and/or modified sequence from HRSV(A2)__F-del_DSCav1_mut6 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6751 - RNA, 1919 nt, synthetic construct
  misc_feature 1..1919: note = mRNA product Design h-3 comprising derived and/or modified sequence from HRSV(A2)__F-del_DSCav1_mut6 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6752 - RNA, 1919 nt, synthetic construct
  misc_feature 1..1919: note = mRNA product Design h-3 comprising derived and/or modified sequence from HRSV(A2)__F-del_DSCav1_mut6 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6753 - RNA, 1919 nt, synthetic construct
  misc_feature 1..1919: note = mRNA product Design h-3 comprising derived and/or modified sequence from HRSV(A2)__F-del_DSCav1_mut6 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6754 - RNA, 1982 nt, synthetic construct
  misc_feature 1..1982: note = mRNA product Design h-4 comprising derived and/or modified sequence from HRSV(A2)__F-del_DSCav1_mut6 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6755 - RNA, 1982 nt, synthetic construct
  misc_feature 1..1982: note = mRNA product Design h-4 comprising derived and/or modified sequence from HRSV(A2)__F-del_DSCav1_mut6 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6756 - RNA, 1982 nt, synthetic construct
  misc_feature 1..1982: note = mRNA product Design h-4 comprising derived and/or modified sequence from HRSV(A2)__F-del_DSCav1_mut6 (opt2)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6757 - RNA, 1982 nt, synthetic construct
  misc_feature 1..1982: note = mRNA product Design h-4 comprising derived and/or modified sequence from HRSV(A2)__F-del_DSCav1_mut6 (opt3)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6758 - RNA, 1982 nt, synthetic construct
  misc_feature 1..1982: note = mRNA product Design h-4 comprising derived and/or modified sequence from HRSV(A2)__F-del_DSCav1_mut6 (opt4)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6759 - RNA, 1982 nt, synthetic construct
  misc_feature 1..1982: note = mRNA product Design h-4 comprising derived and/or modified sequence from HRSV(A2)__F-del_DSCav1_mut6 (opt5)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6760 - RNA, 1982 nt, synthetic construct
  misc_feature 1..1982: note = mRNA product Design h-4 comprising derived and/or modified sequence from HRSV(A2)__F-del_DSCav1_mut6 (opt6)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6761 - RNA, 1982 nt, synthetic construct
  misc_feature 1..1982: note = mRNA product Design h-4 comprising derived and/or modified sequence from HRSV(A2)__F-del_DSCav1_mut6 (opt11)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6762 - RNA, 1998 nt, synthetic construct
  misc_feature 1..1998: note = mRNA product Design h-5 comprising derived and/or modified sequence from HRSV(A2)__F-del_DSCav1_mut6 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6763 - RNA, 1998 nt, synthetic construct
  misc_feature 1..1998: note = mRNA product Design h-5 comprising derived and/or modified sequence from HRSV(A2)__F-del_DSCav1_mut6 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6764 - RNA, 1998 nt, synthetic construct
  misc_feature 1..1998: note = mRNA product Design h-5 comprising derived and/or modified sequence from HRSV(A2)__F-del_DSCav1_mut6 (opt2)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6765 - RNA, 1998 nt, synthetic construct
  misc_feature 1..1998: note = mRNA product Design h-5 comprising derived and/or modified sequence from HRSV(A2)__F-del_DSCav1_mut6 (opt3)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6766 - RNA, 1998 nt, synthetic construct
  misc_feature 1..1998: note = mRNA product Design h-5 comprising derived and/or modified sequence from HRSV(A2)__F-del_DSCav1_mut6 (opt4)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6767 - RNA, 1998 nt, synthetic construct
  misc_feature 1..1998: note = mRNA product Design h-5 comprising derived and/or modified sequence from HRSV(A2)__F-del_DSCav1_mut6 (opt5)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6768 - RNA, 1998 nt, synthetic construct
  misc_feature 1..1998: note = mRNA product Design h-5 comprising derived and/or modified sequence from HRSV(A2)__F-del_DSCav1_mut6 (opt6)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6769 - RNA, 1998 nt, synthetic construct
  misc_feature 1..1998: note = mRNA product Design h-5 comprising derived and/or modified sequence from HRSV(A2)__F-del_DSCav1_mut6 (opt11)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6770 - RNA, 1931 nt, synthetic construct
  misc_feature 1..1931: note = mRNA product Design i-1 comprising derived and/or modified sequence from HRSV(A2)__F-del_DSCav1_mut6 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6771 - RNA, 1931 nt, synthetic construct
  misc_feature 1..1931: note = mRNA product Design i-1 comprising derived and/or modified sequence from HRSV(A2)__F-del_DSCav1_mut6 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6772 - RNA, 1931 nt, synthetic construct
  misc_feature 1..1931: note = mRNA product Design i-1 comprising derived and/or modified sequence from HRSV(A2)__F-del_DSCav1_mut6 (opt2)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6773 - RNA, 1931 nt, synthetic construct
  misc_feature 1..1931: note = mRNA product Design i-1 comprising derived and/or modified sequence from HRSV(A2)__F-del_DSCav1_mut6 (opt3)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6774 - RNA, 1931 nt, synthetic construct
  misc_feature 1..1931: note = mRNA product Design i-1 comprising derived and/or modified sequence from HRSV(A2)__F-del_DSCav1_mut6 (opt4)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6775 - RNA, 1931 nt, synthetic construct
  misc_feature 1..1931: note = mRNA product Design i-1 comprising derived and/or modified sequence from HRSV(A2)__F-del_DSCav1_mut6 (opt5)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6776 - RNA, 1931 nt, synthetic construct
  misc_feature 1..1931: note = mRNA product Design i-1 comprising derived and/or modified sequence from HRSV(A2)__F-del_DSCav1_mut6 (opt6)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6777 - RNA, 1931 nt, synthetic construct
  misc_feature 1..1931: note = mRNA product Design i-1 comprising derived and/or modified sequence from HRSV(A2)__F-del_DSCav1_mut6 (opt11)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6778 - RNA, 1931 nt, synthetic construct
  misc_feature 1..1931: note = mRNA product Design i-2 comprising derived and/or modified sequence from HRSV(A2)__F-del_DSCav1_mut6 (opt1)
  source 1..1931: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6779 - RNA, 1931 nt, synthetic construct
  misc_feature 1..1931: note = mRNA product Design i-2 comprising derived and/or modified sequence from HRSV(A2)__F-del_DSCav1_mut6 (opt1)
  source 1..1931: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6780 - RNA, 1931 nt, synthetic construct
  misc_feature 1..1931: note = mRNA product Design i-2 comprising derived and/or modified sequence from HRSV(A2)__F-del_DSCav1_mut6 (opt2)
  source 1..1931: mol_type = other RNA
gggagaggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6781 - RNA, 1931 nt, synthetic construct
  misc_feature 1..1931: note = mRNA product Design i-2 comprising derived and/or modified sequence from HRSV(A2)__F-del_DSCav1_mut6 (opt3)
  source 1..1931: mol_type = other RNA
gggagaggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6782 - RNA, 1931 nt, synthetic construct
  misc_feature 1..1931: note = mRNA product Design i-2 comprising derived and/or modified sequence from HRSV(A2)__F-del_DSCav1_mut6 (opt4)
  source 1..1931: mol_type = other RNA
gggagaggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6783 - RNA, 1931 nt, synthetic construct
  misc_feature 1..1931: note = mRNA product Design i-2 comprising derived and/or modified sequence from HRSV(A2)__F-del_DSCav1_mut6 (opt5)
  source 1..1931: mol_type = other RNA
gggagaggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6784 - RNA, 1931 nt, synthetic construct
  misc_feature 1..1931: note = mRNA product Design i-2 comprising derived and/or modified sequence from HRSV(A2)__F-del_DSCav1_mut6 (opt6)
  source 1..1931: mol_type = other RNA
gggagaggcgctgcctacggaggtggcagccatctccttctcggcatcaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6785 - RNA, 1931 nt, synthetic construct
  misc_feature 1..1931: note = mRNA product Design i-2 comprising derived and/or modified sequence from HRSV(A2)__F-del_DSCav1_mut6 (opt11)
  source 1..1931: mol_type = other RNA
gggagaggcgctgcctacggaggtggcagccatctccttctcggcatcaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6786 - RNA, 1927 nt, synthetic construct
  misc_feature 1..1927: note = mRNA product Design i-2 comprising derived and/or modified sequence from HRSV(A2)__F-del_DSCav1_mut6 (opt1)
  source 1..1927: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6787 - RNA, 1927 nt, synthetic construct
  misc_feature 1..1927: note = mRNA product Design i-2 comprising derived and/or modified sequence from HRSV(A2)__F-del_DSCav1_mut6 (opt1)
  source 1..1927: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6788 - RNA, 1927 nt, synthetic construct
  misc_feature 1..1927: note = mRNA product Design i-2 comprising derived and/or modified sequence from HRSV(A2)__F-del_DSCav1_mut6 (opt2)
  source 1..1927: mol_type = other RNA
ggggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6789 - RNA, 1927 nt, synthetic construct
  misc_feature 1..1927: note = mRNA product Design i-2 comprising derived and/or modified sequence from HRSV(A2)__F-del_DSCav1_mut6 (opt3)
  source 1..1927: mol_type = other RNA
ggggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6790 - RNA, 1927 nt, synthetic construct
  misc_feature 1..1927: note = mRNA product Design i-2 comprising derived and/or modified sequence from HRSV(A2)__F-del_DSCav1_mut6 (opt4)
  source 1..1927: mol_type = other RNA
ggggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6791 - RNA, 1927 nt, synthetic construct
  misc_feature 1..1927: note = mRNA product Design i-2 comprising derived and/or modified sequence from HRSV(A2)__F-del_DSCav1_mut6 (opt5)
  source 1..1927: mol_type = other RNA
ggggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6792 - RNA, 1927 nt, synthetic construct
  misc_feature 1..1927: note = mRNA product Design i-2 comprising derived and/or modified sequence from HRSV(A2)__F-del_DSCav1_mut6 (opt6)
  source 1..1927: mol_type = other RNA
ggggcgctgcctacggaggtggcagccatctccttctcggcatcaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6793 - RNA, 1927 nt, synthetic construct
  misc_feature 1..1927: note = mRNA product Design i-2 comprising derived and/or modified sequence from HRSV(A2)__F-del_DSCav1_mut6 (opt11)
  source 1..1927: mol_type = other RNA
ggggcgctgcctacggaggtggcagccatctccttctcggcatcaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6794 - RNA, 1762 nt, synthetic construct
  misc_feature 1..1762: note = mRNA product Design i-3 comprising derived and/or modified sequence from HRSV(A2)__F-del_DSCav1_mut6 (opt1)
  source 1..1762: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6795 - RNA, 1762 nt, synthetic construct
  misc_feature 1..1762: note = mRNA product Design i-3 comprising derived and/or modified sequence from HRSV(A2)__F-del_DSCav1_mut6 (opt1)
  source 1..1762: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6796 - RNA, 1762 nt, synthetic construct
  misc_feature 1..1762: note = mRNA product Design i-3 comprising derived and/or modified sequence from HRSV(A2)__F-del_DSCav1_mut6 (opt2)
  source 1..1762: mol_type = other RNA
gggagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6797 - RNA, 1762 nt, synthetic construct
  misc_feature 1..1762: note = mRNA product Design i-3 comprising derived and/or modified sequence from HRSV(A2)__F-del_DSCav1_mut6 (opt3)
  source 1..1762: mol_type = other RNA
gggagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6798 - RNA, 1762 nt, synthetic construct
  misc_feature 1..1762: note = mRNA product Design i-3 comprising derived and/or modified sequence from HRSV(A2)__F-del_DSCav1_mut6 (opt4)
  source 1..1762: mol_type = other RNA
gggagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6799 - RNA, 1762 nt, synthetic construct
  misc_feature 1..1762: note = mRNA product Design i-3 comprising derived and/or modified sequence from HRSV(A2)__F-del_DSCav1_mut6 (opt5)
  source 1..1762: mol_type = other RNA
gggagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6800 - RNA, 1762 nt, synthetic construct
  misc_feature 1..1762: note = mRNA product Design i-3 comprising derived and/or modified sequence from HRSV(A2)__F-del_DSCav1_mut6 (opt6)
  source 1..1762: mol_type = other RNA
gggagaaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6801 - RNA, 1762 nt, synthetic construct
  misc_feature 1..1762: note = mRNA product Design i-3 comprising derived and/or modified sequence from HRSV(A2)__F-del_DSCav1_mut6 (opt11)
  source 1..1762: mol_type = other RNA
gggagaaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6802 - protein, 535 aa, synthetic construct
  REGION 1..535: note = derived and/or modified protein sequence (artificial) from HRSV(A2)__F_DSCav1_mut7
MELLILKANAITTILTAVTFCFASGQNITEEFYQSTCSAVSKGYLSALRTGWYTSVITIELSNIKENKCNGTDAKVKLIKQELDKYKNAVTELQMLMCSTPATGSGSAIASGVAVCKVLHLEGEVNKIKSALLSTNKAVVSLSNGVSVLTFKVLDLKNYIDKQLLPILNKQSCSISNIETVMEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVCSNRVFCDTMNSLTLPSEVNLCNVDIFNPKYDCKIMTSKTDVSSSVITSLGAIVSCYGKTKCTASNKNKGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 6803 - RNA, 1608 nt, synthetic construct
  misc_feature 1..1608: note = derived and/or modified CDS sequence (opt1) from HRSV(A2)__F_DSCav1_mut7
  source 1..1608: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactga

SEQ ID NO: 6804 - RNA, 1608 nt, synthetic construct
  misc_feature 1..1608: note = derived and/or modified CDS sequence (opt1) from HRSV(A2)__F_DSCav1_mut7
  source 1..1608: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactga

SEQ ID NO: 6805 - RNA, 1608 nt, synthetic construct
  misc_feature 1..1608: note = derived and/or modified CDS sequence (opt2) from HRSV(A2)__F_DSCav1_mut7
  source 1..1608: mol_type = other RNA
atggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactga

SEQ ID NO: 6806 - RNA, 1608 nt, synthetic construct
  misc_feature 1..1608: note = derived and/or modified CDS sequence (opt3) from HRSV(A2)__F_DSCav1_mut7
  source 1..1608: mol_type = other RNA
atggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactga

SEQ ID NO: 6807 - RNA, 1608 nt, synthetic construct
  misc_feature 1..1608: note = derived and/or modified CDS sequence (opt4) from HRSV(A2)__F_DSCav1_mut7
  source 1..1608: mol_type = other RNA
atggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactga

SEQ ID NO: 6808 - RNA, 1608 nt, synthetic construct
  misc_feature 1..1608: note = derived and/or modified CDS sequence (opt5) from HRSV(A2)__F_DSCav1_mut7
  source 1..1608: mol_type = other RNA
atggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactga

SEQ ID NO: 6809 - RNA, 1608 nt, synthetic construct
  misc_feature 1..1608: note = derived and/or modified CDS sequence (opt6) from HRSV(A2)__F_DSCav1_mut7
  source 1..1608: mol_type = other RNA
atggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaa

SEQ ID NO: 6810 - RNA, 1608 nt, synthetic construct
  misc_feature 1..1608: note = derived and/or modified CDS sequence (opt11) from HRSV(A2)__F_DSCav1_mut7
  source 1..1608: mol_type = other RNA
atggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaa

SEQ ID NO: 6811 - RNA, 1884 nt, synthetic construct
  misc_feature 1..1884: note = mRNA product Design a-1 comprising derived and/or modified sequence from HRSV(A2)__F_DSCav1_mut7 (opt1)
  source 1..1884: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6812 - RNA, 1884 nt, synthetic construct
  misc_feature 1..1884: note = mRNA product Design a-1 comprising derived and/or modified sequence from HRSV(A2)__F_DSCav1_mut7 (opt1)
  source 1..1884: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6813 - RNA, 1884 nt, synthetic construct
  misc_feature 1..1884: note = mRNA product Design a-1 comprising derived and/or modified sequence from HRSV(A2)__F_DSCav1_mut7 (opt2)
  source 1..1884: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6814 - RNA, 1884 nt, synthetic construct
  misc_feature 1..1884: note = mRNA product Design a-1 comprising derived and/or modified sequence from HRSV(A2)__F_DSCav1_mut7 (opt3)
  source 1..1884: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6815 - RNA, 1884 nt, synthetic construct
  misc_feature 1..1884: note = mRNA product Design a-1 comprising derived and/or modified sequence from HRSV(A2)__F_DSCav1_mut7 (opt4)
  source 1..1884: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6816 - RNA, 1884 nt, synthetic construct
  misc_feature 1..1884: note = mRNA product Design a-1 comprising derived and/or modified sequence from HRSV(A2)__F_DSCav1_mut7 (opt5)
  source 1..1884: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6817 - RNA, 1884 nt, synthetic construct
  misc_feature 1..1884: note = mRNA product Design a-1 comprising derived and/or modified sequence from HRSV(A2)__F_DSCav1_mut7 (opt6)
  source 1..1884: mol_type = other RNA
gggagagtcccgcagtcggcgtccagcggctctgcttgttcgtgtgtgtgtcgttgcaggccttattcaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6818 - RNA, 1884 nt, synthetic construct
  misc_feature 1..1884: note = mRNA product Design a-1 comprising derived and/or modified sequence from HRSV(A2)__F_DSCav1_mut7 (opt11)
  source 1..1884: mol_type = other RNA
gggagagtcccgcagtcggcgtccagcggctctgcttgttcgtgtgtgtgtcgttgcaggccttattcaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6819 - RNA, 1903 nt, synthetic construct
  misc_feature 1..1903: note = mRNA product Design a-2 comprising derived and/or modified sequence from HRSV(A2)__F_DSCav1_mut7 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6820 - RNA, 1903 nt, synthetic construct
  misc_feature 1..1903: note = mRNA product Design a-2 comprising derived and/or modified sequence from HRSV(A2)__F_DSCav1_mut7 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6821 - RNA, 1903 nt, synthetic construct
  misc_feature 1..1903: note = mRNA product Design a-2 comprising derived and/or modified sequence from HRSV(A2)__F_DSCav1_mut7 (opt2)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6822 - RNA, 1903 nt, synthetic construct
  misc_feature 1..1903: note = mRNA product Design a-2 comprising derived and/or modified sequence from HRSV(A2)__F_DSCav1_mut7 (opt3)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6823 - RNA, 1903 nt, synthetic construct
  misc_feature 1..1903: note = mRNA product Design a-2 comprising derived and/or modified sequence from HRSV(A2)__F_DSCav1_mut7 (opt4)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6824 - RNA, 1903 nt, synthetic construct
  misc_feature 1..1903: note = mRNA product Design a-2 comprising derived and/or modified sequence from HRSV(A2)__F_DSCav1_mut7 (opt5)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6825 - RNA, 1903 nt, synthetic construct
  misc_feature 1..1903: note = mRNA product Design a-2 comprising derived and/or modified sequence from HRSV(A2)__F_DSCav1_mut7 (opt6)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6826 - RNA, 1903 nt, synthetic construct
  misc_feature 1..1903: note = mRNA product Design a-2 comprising derived and/or modified sequence from HRSV(A2)__F_DSCav1_mut7 (opt11)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6827 - RNA, 1981 nt, synthetic construct
  misc_feature 1..1981: note = mRNA product Design a-3 comprising derived and/or modified sequence from HRSV(A2)__F_DSCav1_mut7 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6828 - RNA, 1981 nt, synthetic construct
  misc_feature 1..1981: note = mRNA product Design a-3 comprising derived and/or modified sequence from HRSV(A2)__F_DSCav1_mut7 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6829 - RNA, 1981 nt, synthetic construct
  misc_feature 1..1981: note = mRNA product Design a-3 comprising derived and/or modified sequence from HRSV(A2)__F_DSCav1_mut7 (opt2)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6830 - RNA, 1981 nt, synthetic construct
  misc_feature 1..1981: note = mRNA product Design a-3 comprising derived and/or modified sequence from HRSV(A2)__F_DSCav1_mut7 (opt3)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6831 - RNA, 1981 nt, synthetic construct
  misc_feature 1..1981: note = mRNA product Design a-3 comprising derived and/or modified sequence from HRSV(A2)__F_DSCav1_mut7 (opt4)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6832 - RNA, 1981 nt, synthetic construct
  misc_feature 1..1981: note = mRNA product Design a-3 comprising derived and/or modified sequence from HRSV(A2)__F_DSCav1_mut7 (opt5)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6833 - RNA, 1981 nt, synthetic construct
  misc_feature 1..1981: note = mRNA product Design a-3 comprising derived and/or modified sequence from HRSV(A2)__F_DSCav1_mut7 (opt6)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6834 - RNA, 1981 nt, synthetic construct
  misc_feature 1..1981: note = mRNA product Design a-3 comprising derived and/or modified sequence from HRSV(A2)__F_DSCav1_mut7 (opt11)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6835 - RNA, 1930 nt, synthetic construct
  misc_feature 1..1930: note = mRNA product Design a-4 comprising derived and/or modified sequence from HRSV(A2)__F_DSCav1_mut7 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6836 - RNA, 1930 nt, synthetic construct
  misc_feature 1..1930: note = mRNA product Design a-4 comprising derived and/or modified sequence from HRSV(A2)__F_DSCav1_mut7 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6837 - RNA, 1930 nt, synthetic construct
  misc_feature 1..1930: note = mRNA product Design a-4 comprising derived and/or modified sequence from HRSV(A2)__F_DSCav1_mut7 (opt2)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6838 - RNA, 1930 nt, synthetic construct
  misc_feature 1..1930: note = mRNA product Design a-4 comprising derived and/or modified sequence from HRSV(A2)__F_DSCav1_mut7 (opt3)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6839 - RNA, 1930 nt, synthetic construct
  misc_feature 1..1930: note = mRNA product Design a-4 comprising derived and/or modified sequence from HRSV(A2)__F_DSCav1_mut7 (opt4)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6840 - RNA, 1930 nt, synthetic construct
  misc_feature 1..1930: note = mRNA product Design a-4 comprising derived and/or modified sequence from HRSV(A2)__F_DSCav1_mut7 (opt5)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6841 - RNA, 1930 nt, synthetic construct
  misc_feature 1..1930: note = mRNA product Design a-4 comprising derived and/or modified sequence from HRSV(A2)__F_DSCav1_mut7 (opt6)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6842 - RNA, 1930 nt, synthetic construct
  misc_feature 1..1930: note = mRNA product Design a-4 comprising derived and/or modified sequence from HRSV(A2)__F_DSCav1_mut7 (opt11)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6843 - RNA, 1876 nt, synthetic construct
  misc_feature 1..1876: note = mRNA product Design a-5 comprising derived and/or modified sequence from HRSV(A2)__F_DSCav1_mut7 (opt1)
  source 1..1876: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6844 - RNA, 1876 nt, synthetic construct
  misc_feature 1..1876: note = mRNA product Design a-5 comprising derived and/or modified sequence from HRSV(A2)__F_DSCav1_mut7 (opt1)
  source 1..1876: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6845 - RNA, 1876 nt, synthetic construct
  misc_feature 1..1876: note = mRNA product Design a-5 comprising derived and/or modified sequence from HRSV(A2)__F_DSCav1_mut7 (opt2)
  source 1..1876: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6846 - RNA, 1876 nt, synthetic construct
  misc_feature 1..1876: note = mRNA product Design a-5 comprising derived and/or modified sequence from HRSV(A2)__F_DSCav1_mut7 (opt3)
  source 1..1876: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6847 - RNA, 1876 nt, synthetic construct
  misc_feature 1..1876: note = mRNA product Design a-5 comprising derived and/or modified sequence from HRSV(A2)__F_DSCav1_mut7 (opt4)
  source 1..1876: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6848 - RNA, 1876 nt, synthetic construct
  misc_feature 1..1876: note = mRNA product Design a-5 comprising derived and/or modified sequence from HRSV(A2)__F_DSCav1_mut7 (opt5)
  source 1..1876: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6849 - RNA, 1876 nt, synthetic construct
  misc_feature 1..1876: note = mRNA product Design a-5 comprising derived and/or modified sequence from HRSV(A2)__F_DSCav1_mut7 (opt6)
  source 1..1876: mol_type = other RNA
gggagactttcccattctgtagcagaatttggtgttgcctgtggtcttggtcccgcggagaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6850 - RNA, 1876 nt, synthetic construct
  misc_feature 1..1876: note = mRNA product Design a-5 comprising derived and/or modified sequence from HRSV(A2)__F_DSCav1_mut7 (opt11)
  source 1..1876: mol_type = other RNA
gggagactttcccattctgtagcagaatttggtgttgcctgtggtcttggtcccgcggagaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6851 - RNA, 2057 nt, synthetic construct
  misc_feature 1..2057: note = mRNA product Design b-1 comprising derived and/or modified sequence from HRSV(A2)__F_DSCav1_mut7 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6852 - RNA, 2057 nt, synthetic construct
  misc_feature 1..2057: note = mRNA product Design b-1 comprising derived and/or modified sequence from HRSV(A2)__F_DSCav1_mut7 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6853 - RNA, 2057 nt, synthetic construct
  misc_feature 1..2057: note = mRNA product Design b-1 comprising derived and/or modified sequence from HRSV(A2)__F_DSCav1_mut7 (opt2)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6854 - RNA, 2057 nt, synthetic construct
  misc_feature 1..2057: note = mRNA product Design b-1 comprising derived and/or modified sequence from HRSV(A2)__F_DSCav1_mut7 (opt3)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6855 - RNA, 2057 nt, synthetic construct
  misc_feature 1..2057: note = mRNA product Design b-1 comprising derived and/or modified sequence from HRSV(A2)__F_DSCav1_mut7 (opt4)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6856 - RNA, 2057 nt, synthetic construct
  misc_feature 1..2057: note = mRNA product Design b-1 comprising derived and/or modified sequence from HRSV(A2)__F_DSCav1_mut7 (opt5)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6857 - RNA, 2057 nt, synthetic construct
  misc_feature 1..2057: note = mRNA product Design b-1 comprising derived and/or modified sequence from HRSV(A2)__F_DSCav1_mut7 (opt6)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6858 - RNA, 2057 nt, synthetic construct
  misc_feature 1..2057: note = mRNA product Design b-1 comprising derived and/or modified sequence from HRSV(A2)__F_DSCav1_mut7 (opt11)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6859 - RNA, 1877 nt, synthetic construct
  misc_feature 1..1877: note = mRNA product Design b-2 comprising derived and/or modified sequence from HRSV(A2)__F_DSCav1_mut7 (opt1)
  source 1..1877: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6860 - RNA, 1877 nt, synthetic construct
  misc_feature 1..1877: note = mRNA product Design b-2 comprising derived and/or modified sequence from HRSV(A2)__F_DSCav1_mut7 (opt1)
  source 1..1877: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6861 - RNA, 1877 nt, synthetic construct
  misc_feature 1..1877: note = mRNA product Design b-2 comprising derived and/or modified sequence from HRSV(A2)__F_DSCav1_mut7 (opt2)
  source 1..1877: mol_type = other RNA
gggagagcctctgctggagtccggggagtggcgttggctgctagagcgaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6862 - RNA, 1877 nt, synthetic construct
  misc_feature 1..1877: note = mRNA product Design b-2 comprising derived and/or modified sequence from HRSV(A2)__F_DSCav1_mut7 (opt3)
  source 1..1877: mol_type = other RNA
gggagagcctctgctggagtccggggagtggcgttggctgctagagcgaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6863 - RNA, 1877 nt, synthetic construct
  misc_feature 1..1877: note = mRNA product Design b-2 comprising derived and/or modified sequence from HRSV(A2)__F_DSCav1_mut7 (opt4)
  source 1..1877: mol_type = other RNA
gggagagcctctgctggagtccggggagtggcgttggctgctagagcgaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6864 - RNA, 1877 nt, synthetic construct
  misc_feature 1..1877: note = mRNA product Design b-2 comprising derived and/or modified sequence from HRSV(A2)__F_DSCav1_mut7 (opt5)
  source 1..1877: mol_type = other RNA
gggagagcctctgctggagtccggggagtggcgttggctgctagagcgaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6865 - RNA, 1877 nt, synthetic construct
  misc_feature 1..1877: note = mRNA product Design b-2 comprising derived and/or modified sequence from HRSV(A2)__F_DSCav1_mut7 (opt6)
  source 1..1877: mol_type = other RNA
gggagagcctctgctggagtccggggagtggcgttggctgctagagcgaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6866 - RNA, 1877 nt, synthetic construct
  misc_feature 1..1877: note = mRNA product Design b-2 comprising derived and/or modified sequence from HRSV(A2)__F_DSCav1_mut7 (opt11)
  source 1..1877: mol_type = other RNA
gggagagcctctgctggagtccggggagtggcgttggctgctagagcgaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6867 - RNA, 1897 nt, synthetic construct
  misc_feature 1..1897: note = mRNA product Design b-3 comprising derived and/or modified sequence from HRSV(A2)__F_DSCav1_mut7 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6868 - RNA, 1897 nt, synthetic construct
  misc_feature 1..1897: note = mRNA product Design b-3 comprising derived and/or modified sequence from HRSV(A2)__F_DSCav1_mut7 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6869 - RNA, 1897 nt, synthetic construct
  misc_feature 1..1897: note = mRNA product Design b-3 comprising derived and/or modified sequence from HRSV(A2)__F_DSCav1_mut7 (opt2)
  source 1..1897: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6870 - RNA, 1897 nt, synthetic construct
  misc_feature 1..1897: note = mRNA product Design b-3 comprising derived and/or modified sequence from HRSV(A2)__F_DSCav1_mut7 (opt3)
  source 1..1897: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6871 - RNA, 1897 nt, synthetic construct
  misc_feature 1..1897: note = mRNA product Design b-3 comprising derived and/or modified sequence from HRSV(A2)__F_DSCav1_mut7 (opt4)
  source 1..1897: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6872 - RNA, 1897 nt, synthetic construct
  misc_feature 1..1897: note = mRNA product Design b-3 comprising derived and/or modified sequence from HRSV(A2)__F_DSCav1_mut7 (opt5)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6873 - RNA, 1897 nt, synthetic construct
  misc_feature 1..1897: note = mRNA product Design b-3 comprising derived and/or modified sequence from HRSV(A2)__F_DSCav1_mut7 (opt6)
  source 1..1897: mol_type = other RNA
gggagagtcccgcagtcggcgtccagcggctctgcttgttcgtgtgtgtgtcgttgcaggccttattcaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6874 - RNA, 1897 nt, synthetic construct
  misc_feature 1..1897: note = mRNA product Design b-3 comprising derived and/or modified sequence from HRSV(A2)__F_DSCav1_mut7 (opt11)
  source 1..1897: mol_type = other RNA
gggagagtcccgcagtcggcgtccagcggctctgcttgttcgtgtgtgtgtcgttgcaggccttattcaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6875 - RNA, 1948 nt, synthetic construct
  misc_feature 1..1948: note = mRNA product Design b-4 comprising derived and/or modified sequence from HRSV(A2)__F_DSCav1_mut7 (opt1)
  source 1..1948: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6876 - RNA, 1948 nt, synthetic construct
  misc_feature 1..1948: note = mRNA product Design b-4 comprising derived and/or modified sequence from HRSV(A2)__F_DSCav1_mut7 (opt1)
  source 1..1948: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6877 - RNA, 1948 nt, synthetic construct
  misc_feature 1..1948: note = mRNA product Design b-4 comprising derived and/or modified sequence from HRSV(A2)__F_DSCav1_mut7 (opt2)
  source 1..1948: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6878 - RNA, 1948 nt, synthetic construct
  misc_feature 1..1948: note = mRNA product Design b-4 comprising derived and/or modified sequence from HRSV(A2)__F_DSCav1_mut7 (opt3)
  source 1..1948: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6879 - RNA, 1948 nt, synthetic construct
  misc_feature 1..1948: note = mRNA product Design b-4 comprising derived and/or modified sequence from HRSV(A2)__F_DSCav1_mut7 (opt4)
  source 1..1948: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6880 - RNA, 1948 nt, synthetic construct
  misc_feature 1..1948: note = mRNA product Design b-4 comprising derived and/or modified sequence from HRSV(A2)__F_DSCav1_mut7 (opt5)
  source 1..1948: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6881 - RNA, 1948 nt, synthetic construct
  misc_feature 1..1948: note = mRNA product Design b-4 comprising derived and/or modified sequence from HRSV(A2)__F_DSCav1_mut7 (opt6)
  source 1..1948: mol_type = other RNA
gggagagtcccgcagtcggcgtccagcggctctgcttgttcgtgtgtgtgtcgttgcaggccttattcaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6882 - RNA, 1948 nt, synthetic construct
  misc_feature 1..1948: note = mRNA product Design b-4 comprising derived and/or modified sequence from HRSV(A2)__F_DSCav1_mut7 (opt11)
  source 1..1948: mol_type = other RNA
gggagagtcccgcagtcggcgtccagcggctctgcttgttcgtgtgtgtgtcgttgcaggccttattcaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6883 - RNA, 2010 nt, synthetic construct
  misc_feature 1..2010: note = mRNA product Design b-5 comprising derived and/or modified sequence from HRSV(A2)__F_DSCav1_mut7 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6884 - RNA, 2010 nt, synthetic construct
  misc_feature 1..2010: note = mRNA product Design b-5 comprising derived and/or modified sequence from HRSV(A2)__F_DSCav1_mut7 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6885 - RNA, 2010 nt, synthetic construct
  misc_feature 1..2010: note = mRNA product Design b-5 comprising derived and/or modified sequence from HRSV(A2)__F_DSCav1_mut7 (opt2)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6886 - RNA, 2010 nt, synthetic construct
  misc_feature 1..2010: note = mRNA product Design b-5 comprising derived and/or modified sequence from HRSV(A2)__F_DSCav1_mut7 (opt3)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6887 - RNA, 2010 nt, synthetic construct
  misc_feature 1..2010: note = mRNA product Design b-5 comprising derived and/or modified sequence from HRSV(A2)__F_DSCav1_mut7 (opt4)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6888 - RNA, 2010 nt, synthetic construct
  misc_feature 1..2010: note = mRNA product Design b-5 comprising derived and/or modified sequence from HRSV(A2)__F_DSCav1_mut7 (opt5)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6889 - RNA, 2010 nt, synthetic construct
  misc_feature 1..2010: note = mRNA product Design b-5 comprising derived and/or modified sequence from HRSV(A2)__F_DSCav1_mut7 (opt6)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6890 - RNA, 2010 nt, synthetic construct
  misc_feature 1..2010: note = mRNA product Design b-5 comprising derived and/or modified sequence from HRSV(A2)__F_DSCav1_mut7 (opt11)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6891 - RNA, 1916 nt, synthetic construct
  misc_feature 1..1916: note = mRNA product Design c-1 comprising derived and/or modified sequence from HRSV(A2)__F_DSCav1_mut7 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6892 - RNA, 1916 nt, synthetic construct
  misc_feature 1..1916: note = mRNA product Design c-1 comprising derived and/or modified sequence from HRSV(A2)__F_DSCav1_mut7 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6893 - RNA, 1916 nt, synthetic construct
  misc_feature 1..1916: note = mRNA product Design c-1 comprising derived and/or modified sequence from HRSV(A2)__F_DSCav1_mut7 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6894 - RNA, 1916 nt, synthetic construct
  misc_feature 1..1916: note = mRNA product Design c-1 comprising derived and/or modified sequence from HRSV(A2)__F_DSCav1_mut7 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6895 - RNA, 1916 nt, synthetic construct
  misc_feature 1..1916: note = mRNA product Design c-1 comprising derived and/or modified sequence from HRSV(A2)__F_DSCav1_mut7 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6896 - RNA, 1916 nt, synthetic construct
  misc_feature 1..1916: note = mRNA product Design c-1 comprising derived and/or modified sequence from HRSV(A2)__F_DSCav1_mut7 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6897 - RNA, 1916 nt, synthetic construct
  misc_feature 1..1916: note = mRNA product Design c-1 comprising derived and/or modified sequence from HRSV(A2)__F_DSCav1_mut7 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6898 - RNA, 1916 nt, synthetic construct
  misc_feature 1..1916: note = mRNA product Design c-1 comprising derived and/or modified sequence from HRSV(A2)__F_DSCav1_mut7 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6899 - RNA, 2006 nt, synthetic construct
  misc_feature 1..2006: note = mRNA product Design c-2 comprising derived and/or modified sequence from HRSV(A2)__F_DSCav1_mut7 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6900 - RNA, 2006 nt, synthetic construct
  misc_feature 1..2006: note = mRNA product Design c-2 comprising derived and/or modified sequence from HRSV(A2)__F_DSCav1_mut7 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6901 - RNA, 2006 nt, synthetic construct
  misc_feature 1..2006: note = mRNA product Design c-2 comprising derived and/or modified sequence from HRSV(A2)__F_DSCav1_mut7 (opt2)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6902 - RNA, 2006 nt, synthetic construct
  misc_feature 1..2006: note = mRNA product Design c-2 comprising derived and/or modified sequence from HRSV(A2)__F_DSCav1_mut7 (opt3)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6903 - RNA, 2006 nt, synthetic construct
  misc_feature 1..2006: note = mRNA product Design c-2 comprising derived and/or modified sequence from HRSV(A2)__F_DSCav1_mut7 (opt4)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6904 - RNA, 2006 nt, synthetic construct
  misc_feature 1..2006: note = mRNA product Design c-2 comprising derived and/or modified sequence from HRSV(A2)__F_DSCav1_mut7 (opt5)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6905 - RNA, 2006 nt, synthetic construct
  misc_feature 1..2006: note = mRNA product Design c-2 comprising derived and/or modified sequence from HRSV(A2)__F_DSCav1_mut7 (opt6)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6906 - RNA, 2006 nt, synthetic construct
  misc_feature 1..2006: note = mRNA product Design c-2 comprising derived and/or modified sequence from HRSV(A2)__F_DSCav1_mut7 (opt11)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6907 - RNA, 1983 nt, synthetic construct
  misc_feature 1..1983: note = mRNA product Design c-3 comprising derived and/or modified sequence from HRSV(A2)__F_DSCav1_mut7 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6908 - RNA, 1983 nt, synthetic construct
  misc_feature 1..1983: note = mRNA product Design c-3 comprising derived and/or modified sequence from HRSV(A2)__F_DSCav1_mut7 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6909 - RNA, 1983 nt, synthetic construct
  misc_feature 1..1983: note = mRNA product Design c-3 comprising derived and/or modified sequence from HRSV(A2)__F_DSCav1_mut7 (opt2)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6910 - RNA, 1983 nt, synthetic construct
  misc_feature 1..1983: note = mRNA product Design c-3 comprising derived and/or modified sequence from HRSV(A2)__F_DSCav1_mut7 (opt3)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6911 - RNA, 1983 nt, synthetic construct
  misc_feature 1..1983: note = mRNA product Design c-3 comprising derived and/or modified sequence from HRSV(A2)__F_DSCav1_mut7 (opt4)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6912 - RNA, 1983 nt, synthetic construct
  misc_feature 1..1983: note = mRNA product Design c-3 comprising derived and/or modified sequence from HRSV(A2)__F_DSCav1_mut7 (opt5)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6913 - RNA, 1983 nt, synthetic construct
  misc_feature 1..1983: note = mRNA product Design c-3 comprising derived and/or modified sequence from HRSV(A2)__F_DSCav1_mut7 (opt6)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6914 - RNA, 1983 nt, synthetic construct
  misc_feature 1..1983: note = mRNA product Design c-3 comprising derived and/or modified sequence from HRSV(A2)__F_DSCav1_mut7 (opt11)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6915 - RNA, 1979 nt, synthetic construct
  misc_feature 1..1979: note = mRNA product Design c-4 comprising derived and/or modified sequence from HRSV(A2)__F_DSCav1_mut7 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6916 - RNA, 1979 nt, synthetic construct
  misc_feature 1..1979: note = mRNA product Design c-4 comprising derived and/or modified sequence from HRSV(A2)__F_DSCav1_mut7 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6917 - RNA, 1979 nt, synthetic construct
  misc_feature 1..1979: note = mRNA product Design c-4 comprising derived and/or modified sequence from HRSV(A2)__F_DSCav1_mut7 (opt2)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6918 - RNA, 1979 nt, synthetic construct
  misc_feature 1..1979: note = mRNA product Design c-4 comprising derived and/or modified sequence from HRSV(A2)__F_DSCav1_mut7 (opt3)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6919 - RNA, 1979 nt, synthetic construct
  misc_feature 1..1979: note = mRNA product Design c-4 comprising derived and/or modified sequence from HRSV(A2)__F_DSCav1_mut7 (opt4)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6920 - RNA, 1979 nt, synthetic construct
  misc_feature 1..1979: note = mRNA product Design c-4 comprising derived and/or modified sequence from HRSV(A2)__F_DSCav1_mut7 (opt5)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6921 - RNA, 1979 nt, synthetic construct
  misc_feature 1..1979: note = mRNA product Design c-4 comprising derived and/or modified sequence from HRSV(A2)__F_DSCav1_mut7 (opt6)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6922 - RNA, 1979 nt, synthetic construct
  misc_feature 1..1979: note = mRNA product Design c-4 comprising derived and/or modified sequence from HRSV(A2)__F_DSCav1_mut7 (opt11)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6923 - RNA, 1897 nt, synthetic construct
  misc_feature 1..1897: note = mRNA product Design c-5 comprising derived and/or modified sequence from HRSV(A2)__F_DSCav1_mut7 (opt1)
  source 1..1897: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6924 - RNA, 1897 nt, synthetic construct
  misc_feature 1..1897: note = mRNA product Design c-5 comprising derived and/or modified sequence from HRSV(A2)__F_DSCav1_mut7 (opt1)
  source 1..1897: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6925 - RNA, 1897 nt, synthetic construct
  misc_feature 1..1897: note = mRNA product Design c-5 comprising derived and/or modified sequence from HRSV(A2)__F_DSCav1_mut7 (opt2)
  source 1..1897: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6926 - RNA, 1897 nt, synthetic construct
  misc_feature 1..1897: note = mRNA product Design c-5 comprising derived and/or modified sequence from HRSV(A2)__F_DSCav1_mut7 (opt3)
  source 1..1897: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6927 - RNA, 1897 nt, synthetic construct
  misc_feature 1..1897: note = mRNA product Design c-5 comprising derived and/or modified sequence from HRSV(A2)__F_DSCav1_mut7 (opt4)
  source 1..1897: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6928 - RNA, 1897 nt, synthetic construct
  misc_feature 1..1897: note = mRNA product Design c-5 comprising derived and/or modified sequence from HRSV(A2)__F_DSCav1_mut7 (opt5)
  source 1..1897: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6929 - RNA, 1897 nt, synthetic construct
  misc_feature 1..1897: note = mRNA product Design c-5 comprising derived and/or modified sequence from HRSV(A2)__F_DSCav1_mut7 (opt6)
  source 1..1897: mol_type = other RNA
gggagagcggctcggccattttgtcccagtcagtccggaggctgcggctgcagaagtaccgcctgcggagtaactgcaaagaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6930 - RNA, 1897 nt, synthetic construct
  misc_feature 1..1897: note = mRNA product Design c-5 comprising derived and/or modified sequence from HRSV(A2)__F_DSCav1_mut7 (opt11)
  source 1..1897: mol_type = other RNA
gggagagcggctcggccattttgtcccagtcagtccggaggctgcggctgcagaagtaccgcctgcggagtaactgcaaagaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6931 - RNA, 1906 nt, synthetic construct
  misc_feature 1..1906: note = mRNA product Design d-1 comprising derived and/or modified sequence from HRSV(A2)__F_DSCav1_mut7 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6932 - RNA, 1906 nt, synthetic construct
  misc_feature 1..1906: note = mRNA product Design d-1 comprising derived and/or modified sequence from HRSV(A2)__F_DSCav1_mut7 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6933 - RNA, 1906 nt, synthetic construct
  misc_feature 1..1906: note = mRNA product Design d-1 comprising derived and/or modified sequence from HRSV(A2)__F_DSCav1_mut7 (opt2)
  source 1..1906: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6934 - RNA, 1906 nt, synthetic construct
  misc_feature 1..1906: note = mRNA product Design d-1 comprising derived and/or modified sequence from HRSV(A2)__F_DSCav1_mut7 (opt3)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6935 - RNA, 1906 nt, synthetic construct
  misc_feature 1..1906: note = mRNA product Design d-1 comprising derived and/or modified sequence from HRSV(A2)__F_DSCav1_mut7 (opt4)
  source 1..1906: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6936 - RNA, 1906 nt, synthetic construct
  misc_feature 1..1906: note = mRNA product Design d-1 comprising derived and/or modified sequence from HRSV(A2)__F_DSCav1_mut7 (opt5)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6937 - RNA, 1906 nt, synthetic construct
  misc_feature 1..1906: note = mRNA product Design d-1 comprising derived and/or modified sequence from HRSV(A2)__F_DSCav1_mut7 (opt6)
  source 1..1906: mol_type = other RNA
gggagacccgtgacccggaagttgtacggctacgcgactttccctcccacaaaccctcgcgcccttcctttcctacttgggcccggcagaaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6938 - RNA, 1906 nt, synthetic construct
  misc_feature 1..1906: note = mRNA product Design d-1 comprising derived and/or modified sequence from HRSV(A2)__F_DSCav1_mut7 (opt11)
  source 1..1906: mol_type = other RNA
gggagacccgtgacccggaagttgtacggctacgcgactttccctcccacaaaccctcgcgcccttcctttcctacttgggcccggcagaaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6939 - RNA, 1961 nt, synthetic construct
  misc_feature 1..1961: note = mRNA product Design d-2 comprising derived and/or modified sequence from HRSV(A2)__F_DSCav1_mut7 (opt1)
  source 1..1961: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6940 - RNA, 1961 nt, synthetic construct
  misc_feature 1..1961: note = mRNA product Design d-2 comprising derived and/or modified sequence from HRSV(A2)__F_DSCav1_mut7 (opt1)
  source 1..1961: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6941 - RNA, 1961 nt, synthetic construct
  misc_feature 1..1961: note = mRNA product Design d-2 comprising derived and/or modified sequence from HRSV(A2)__F_DSCav1_mut7 (opt2)
  source 1..1961: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6942 - RNA, 1961 nt, synthetic construct
  misc_feature 1..1961: note = mRNA product Design d-2 comprising derived and/or modified sequence from HRSV(A2)__F_DSCav1_mut7 (opt3)
  source 1..1961: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6943 - RNA, 1961 nt, synthetic construct
  misc_feature 1..1961: note = mRNA product Design d-2 comprising derived and/or modified sequence from HRSV(A2)__F_DSCav1_mut7 (opt4)
  source 1..1961: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6944 - RNA, 1961 nt, synthetic construct
  misc_feature 1..1961: note = mRNA product Design d-2 comprising derived and/or modified sequence from HRSV(A2)__F_DSCav1_mut7 (opt5)
  source 1..1961: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6945 - RNA, 1961 nt, synthetic construct
  misc_feature 1..1961: note = mRNA product Design d-2 comprising derived and/or modified sequence from HRSV(A2)__F_DSCav1_mut7 (opt6)
  source 1..1961: mol_type = other RNA
gggagagcggctcggccattttgtcccagtcagtccggaggctgcggctgcagaagtaccgcctgcggagtaactgcaaagaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6946 - RNA, 1961 nt, synthetic construct
  misc_feature 1..1961: note = mRNA product Design d-2 comprising derived and/or modified sequence from HRSV(A2)__F_DSCav1_mut7 (opt11)
  source 1..1961: mol_type = other RNA
gggagagcggctcggccattttgtcccagtcagtccggaggctgcggctgcagaagtaccgcctgcggagtaactgcaaagaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6947 - RNA, 2277 nt, synthetic construct
  misc_feature 1..2277: note = mRNA product Design d-3 comprising derived and/or modified sequence from HRSV(A2)__F_DSCav1_mut7 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6948 - RNA, 2277 nt, synthetic construct
  misc_feature 1..2277: note = mRNA product Design d-3 comprising derived and/or modified sequence from HRSV(A2)__F_DSCav1_mut7 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6949 - RNA, 2277 nt, synthetic construct
  misc_feature 1..2277: note = mRNA product Design d-3 comprising derived and/or modified sequence from HRSV(A2)__F_DSCav1_mut7 (opt2)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6950 - RNA, 2277 nt, synthetic construct
  misc_feature 1..2277: note = mRNA product Design d-3 comprising derived and/or modified sequence from HRSV(A2)__F_DSCav1_mut7 (opt3)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6951 - RNA, 2277 nt, synthetic construct
  misc_feature 1..2277: note = mRNA product Design d-3 comprising derived and/or modified sequence from HRSV(A2)__F_DSCav1_mut7 (opt4)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6952 - RNA, 2277 nt, synthetic construct
  misc_feature 1..2277: note = mRNA product Design d-3 comprising derived and/or modified sequence from HRSV(A2)__F_DSCav1_mut7 (opt5)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6953 - RNA, 2277 nt, synthetic construct
  misc_feature 1..2277: note = mRNA product Design d-3 comprising derived and/or modified sequence from HRSV(A2)__F_DSCav1_mut7 (opt6)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6954 - RNA, 2277 nt, synthetic construct
  misc_feature 1..2277: note = mRNA product Design d-3 comprising derived and/or modified sequence from HRSV(A2)__F_DSCav1_mut7 (opt11)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6955 - RNA, 1960 nt, synthetic construct
  misc_feature 1..1960: note = mRNA product Design d-4 comprising derived and/or modified sequence from HRSV(A2)__F_DSCav1_mut7 (opt1)
  source 1..1960: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6956 - RNA, 1960 nt, synthetic construct
  misc_feature 1..1960: note = mRNA product Design d-4 comprising derived and/or modified sequence from HRSV(A2)__F_DSCav1_mut7 (opt1)
  source 1..1960: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6957 - RNA, 1960 nt, synthetic construct
  misc_feature 1..1960: note = mRNA product Design d-4 comprising derived and/or modified sequence from HRSV(A2)__F_DSCav1_mut7 (opt2)
  source 1..1960: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6958 - RNA, 1960 nt, synthetic construct
  misc_feature 1..1960: note = mRNA product Design d-4 comprising derived and/or modified sequence from HRSV(A2)__F_DSCav1_mut7 (opt3)
  source 1..1960: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6959 - RNA, 1960 nt, synthetic construct
  misc_feature 1..1960: note = mRNA product Design d-4 comprising derived and/or modified sequence from HRSV(A2)__F_DSCav1_mut7 (opt4)
  source 1..1960: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6960 - RNA, 1960 nt, synthetic construct
  misc_feature 1..1960: note = mRNA product Design d-4 comprising derived and/or modified sequence from HRSV(A2)__F_DSCav1_mut7 (opt5)
  source 1..1960: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6961 - RNA, 1960 nt, synthetic construct
  misc_feature 1..1960: note = mRNA product Design d-4 comprising derived and/or modified sequence from HRSV(A2)__F_DSCav1_mut7 (opt6)
  source 1..1960: mol_type = other RNA
gggagagtcccgcagtcggcgtccagcggctctgcttgttcgtgtgtgtgtcgttgcaggccttattcaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6962 - RNA, 1960 nt, synthetic construct
  misc_feature 1..1960: note = mRNA product Design d-4 comprising derived and/or modified sequence from HRSV(A2)__F_DSCav1_mut7 (opt11)
  source 1..1960: mol_type = other RNA
gggagagtcccgcagtcggcgtccagcggctctgcttgttcgtgtgtgtgtcgttgcaggccttattcaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6963 - RNA, 2057 nt, synthetic construct
  misc_feature 1..2057: note = mRNA product Design d-5 comprising derived and/or modified sequence from HRSV(A2)__F_DSCav1_mut7 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6964 - RNA, 2057 nt, synthetic construct
  misc_feature 1..2057: note = mRNA product Design d-5 comprising derived and/or modified sequence from HRSV(A2)__F_DSCav1_mut7 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6965 - RNA, 2057 nt, synthetic construct
  misc_feature 1..2057: note = mRNA product Design d-5 comprising derived and/or modified sequence from HRSV(A2)__F_DSCav1_mut7 (opt2)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6966 - RNA, 2057 nt, synthetic construct
  misc_feature 1..2057: note = mRNA product Design d-5 comprising derived and/or modified sequence from HRSV(A2)__F_DSCav1_mut7 (opt3)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6967 - RNA, 2057 nt, synthetic construct
  misc_feature 1..2057: note = mRNA product Design d-5 comprising derived and/or modified sequence from HRSV(A2)__F_DSCav1_mut7 (opt4)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6968 - RNA, 2057 nt, synthetic construct
  misc_feature 1..2057: note = mRNA product Design d-5 comprising derived and/or modified sequence from HRSV(A2)__F_DSCav1_mut7 (opt5)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6969 - RNA, 2057 nt, synthetic construct
  misc_feature 1..2057: note = mRNA product Design d-5 comprising derived and/or modified sequence from HRSV(A2)__F_DSCav1_mut7 (opt6)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6970 - RNA, 2057 nt, synthetic construct
  misc_feature 1..2057: note = mRNA product Design d-5 comprising derived and/or modified sequence from HRSV(A2)__F_DSCav1_mut7 (opt11)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6971 - RNA, 1937 nt, synthetic construct
  misc_feature 1..1937: note = mRNA product Design e-1 comprising derived and/or modified sequence from HRSV(A2)__F_DSCav1_mut7 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6972 - RNA, 1937 nt, synthetic construct
  misc_feature 1..1937: note = mRNA product Design e-1 comprising derived and/or modified sequence from HRSV(A2)__F_DSCav1_mut7 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6973 - RNA, 1937 nt, synthetic construct
  misc_feature 1..1937: note = mRNA product Design e-1 comprising derived and/or modified sequence from HRSV(A2)__F_DSCav1_mut7 (opt2)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6974 - RNA, 1937 nt, synthetic construct
  misc_feature 1..1937: note = mRNA product Design e-1 comprising derived and/or modified sequence from HRSV(A2)__F_DSCav1_mut7 (opt3)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6975 - RNA, 1937 nt, synthetic construct
  misc_feature 1..1937: note = mRNA product Design e-1 comprising derived and/or modified sequence from HRSV(A2)__F_DSCav1_mut7 (opt4)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6976 - RNA, 1937 nt, synthetic construct
  misc_feature 1..1937: note = mRNA product Design e-1 comprising derived and/or modified sequence from HRSV(A2)__F_DSCav1_mut7 (opt5)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6977 - RNA, 1937 nt, synthetic construct
  misc_feature 1..1937: note = mRNA product Design e-1 comprising derived and/or modified sequence from HRSV(A2)__F_DSCav1_mut7 (opt6)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6978 - RNA, 1937 nt, synthetic construct
  misc_feature 1..1937: note = mRNA product Design e-1 comprising derived and/or modified sequence from HRSV(A2)__F_DSCav1_mut7 (opt11)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6979 - RNA, 1919 nt, synthetic construct
  misc_feature 1..1919: note = mRNA product Design e-2 comprising derived and/or modified sequence from HRSV(A2)__F_DSCav1_mut7 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6980 - RNA, 1919 nt, synthetic construct
  misc_feature 1..1919: note = mRNA product Design e-2 comprising derived and/or modified sequence from HRSV(A2)__F_DSCav1_mut7 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6981 - RNA, 1919 nt, synthetic construct
  misc_feature 1..1919: note = mRNA product Design e-2 comprising derived and/or modified sequence from HRSV(A2)__F_DSCav1_mut7 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6982 - RNA, 1919 nt, synthetic construct
  misc_feature 1..1919: note = mRNA product Design e-2 comprising derived and/or modified sequence from HRSV(A2)__F_DSCav1_mut7 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6983 - RNA, 1919 nt, synthetic construct
  misc_feature 1..1919: note = mRNA product Design e-2 comprising derived and/or modified sequence from HRSV(A2)__F_DSCav1_mut7 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6984 - RNA, 1919 nt, synthetic construct
  misc_feature 1..1919: note = mRNA product Design e-2 comprising derived and/or modified sequence from HRSV(A2)__F_DSCav1_mut7 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6985 - RNA, 1919 nt, synthetic construct
  misc_feature 1..1919: note = mRNA product Design e-2 comprising derived and/or modified sequence from HRSV(A2)__F_DSCav1_mut7 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6986 - RNA, 1919 nt, synthetic construct
  misc_feature 1..1919: note = mRNA product Design e-2 comprising derived and/or modified sequence from HRSV(A2)__F_DSCav1_mut7 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6987 - RNA, 1889 nt, synthetic construct
  misc_feature 1..1889: note = mRNA product Design e-3 comprising derived and/or modified sequence from HRSV(A2)__F_DSCav1_mut7 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6988 - RNA, 1889 nt, synthetic construct
  misc_feature 1..1889: note = mRNA product Design e-3 comprising derived and/or modified sequence from HRSV(A2)__F_DSCav1_mut7 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6989 - RNA, 1889 nt, synthetic construct
  misc_feature 1..1889: note = mRNA product Design e-3 comprising derived and/or modified sequence from HRSV(A2)__F_DSCav1_mut7 (opt2)
  source 1..1889: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6990 - RNA, 1889 nt, synthetic construct
  misc_feature 1..1889: note = mRNA product Design e-3 comprising derived and/or modified sequence from HRSV(A2)__F_DSCav1_mut7 (opt3)
  source 1..1889: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6991 - RNA, 1889 nt, synthetic construct
  misc_feature 1..1889: note = mRNA product Design e-3 comprising derived and/or modified sequence from HRSV(A2)__F_DSCav1_mut7 (opt4)
  source 1..1889: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6992 - RNA, 1889 nt, synthetic construct
  misc_feature 1..1889: note = mRNA product Design e-3 comprising derived and/or modified sequence from HRSV(A2)__F_DSCav1_mut7 (opt5)
  source 1..1889: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6993 - RNA, 1889 nt, synthetic construct
  misc_feature 1..1889: note = mRNA product Design e-3 comprising derived and/or modified sequence from HRSV(A2)__F_DSCav1_mut7 (opt6)
  source 1..1889: mol_type = other RNA
gggagactttcccattctgtagcagaatttggtgttgcctgtggtcttggtcccgcggagaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6994 - RNA, 1889 nt, synthetic construct
  misc_feature 1..1889: note = mRNA product Design e-3 comprising derived and/or modified sequence from HRSV(A2)__F_DSCav1_mut7 (opt11)
  source 1..1889: mol_type = other RNA
gggagactttcccattctgtagcagaatttggtgttgcctgtggtcttggtcccgcggagaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6995 - RNA, 1943 nt, synthetic construct
  misc_feature 1..1943: note = mRNA product Design e-4 comprising derived and/or modified sequence from HRSV(A2)__F_DSCav1_mut7 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6996 - RNA, 1943 nt, synthetic construct
  misc_feature 1..1943: note = mRNA product Design e-4 comprising derived and/or modified sequence from HRSV(A2)__F_DSCav1_mut7 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6997 - RNA, 1943 nt, synthetic construct
  misc_feature 1..1943: note = mRNA product Design e-4 comprising derived and/or modified sequence from HRSV(A2)__F_DSCav1_mut7 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6998 - RNA, 1943 nt, synthetic construct
  misc_feature 1..1943: note = mRNA product Design e-4 comprising derived and/or modified sequence from HRSV(A2)__F_DSCav1_mut7 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6999 - RNA, 1943 nt, synthetic construct
  misc_feature 1..1943: note = mRNA product Design e-4 comprising derived and/or modified sequence from HRSV(A2)__F_DSCav1_mut7 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7000 - RNA, 1943 nt, synthetic construct
  misc_feature 1..1943: note = mRNA product Design e-4 comprising derived and/or modified sequence from HRSV(A2)__F_DSCav1_mut7 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7001 - RNA, 1943 nt, synthetic construct
  misc_feature 1..1943: note = mRNA product Design e-4 comprising derived and/or modified sequence from HRSV(A2)__F_DSCav1_mut7 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7002 - RNA, 1943 nt, synthetic construct
  misc_feature 1..1943: note = mRNA product Design e-4 comprising derived and/or modified sequence from HRSV(A2)__F_DSCav1_mut7 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7003 - RNA, 1910 nt, synthetic construct
  misc_feature 1..1910: note = mRNA product Design e-5 comprising derived and/or modified sequence from HRSV(A2)__F_DSCav1_mut7 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7004 - RNA, 1910 nt, synthetic construct
  misc_feature 1..1910: note = mRNA product Design e-5 comprising derived and/or modified sequence from HRSV(A2)__F_DSCav1_mut7 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7005 - RNA, 1910 nt, synthetic construct
  misc_feature 1..1910: note = mRNA product Design e-5 comprising derived and/or modified sequence from HRSV(A2)__F_DSCav1_mut7 (opt2)
  source 1..1910: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7006 - RNA, 1910 nt, synthetic construct
  misc_feature 1..1910: note = mRNA product Design e-5 comprising derived and/or modified sequence from HRSV(A2)__F_DSCav1_mut7 (opt3)
  source 1..1910: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7007 - RNA, 1910 nt, synthetic construct
  misc_feature 1..1910: note = mRNA product Design e-5 comprising derived and/or modified sequence from HRSV(A2)__F_DSCav1_mut7 (opt4)
  source 1..1910: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7008 - RNA, 1910 nt, synthetic construct
  misc_feature 1..1910: note = mRNA product Design e-5 comprising derived and/or modified sequence from HRSV(A2)__F_DSCav1_mut7 (opt5)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7009 - RNA, 1910 nt, synthetic construct
  misc_feature 1..1910: note = mRNA product Design e-5 comprising derived and/or modified sequence from HRSV(A2)__F_DSCav1_mut7 (opt6)
  source 1..1910: mol_type = other RNA
gggagagcggctcggccattttgtcccagtcagtccggaggctgcggctgcagaagtaccgcctgcggagtaactgcaaagaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7010 - RNA, 1910 nt, synthetic construct
  misc_feature 1..1910: note = mRNA product Design e-5 comprising derived and/or modified sequence from HRSV(A2)__F_DSCav1_mut7 (opt11)
  source 1..1910: mol_type = other RNA
gggagagcggctcggccattttgtcccagtcagtccggaggctgcggctgcagaagtaccgcctgcggagtaactgcaaagaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7011 - RNA, 1977 nt, synthetic construct
  misc_feature 1..1977: note = mRNA product Design e-6 comprising derived and/or modified sequence from HRSV(A2)__F_DSCav1_mut7 (opt1)
  source 1..1977: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7012 - RNA, 1977 nt, synthetic construct
  misc_feature 1..1977: note = mRNA product Design e-6 comprising derived and/or modified sequence from HRSV(A2)__F_DSCav1_mut7 (opt1)
  source 1..1977: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7013 - RNA, 1977 nt, synthetic construct
  misc_feature 1..1977: note = mRNA product Design e-6 comprising derived and/or modified sequence from HRSV(A2)__F_DSCav1_mut7 (opt2)
  source 1..1977: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7014 - RNA, 1977 nt, synthetic construct
  misc_feature 1..1977: note = mRNA product Design e-6 comprising derived and/or modified sequence from HRSV(A2)__F_DSCav1_mut7 (opt3)
  source 1..1977: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7015 - RNA, 1977 nt, synthetic construct
  misc_feature 1..1977: note = mRNA product Design e-6 comprising derived and/or modified sequence from HRSV(A2)__F_DSCav1_mut7 (opt4)
  source 1..1977: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7016 - RNA, 1977 nt, synthetic construct
  misc_feature 1..1977: note = mRNA product Design e-6 comprising derived and/or modified sequence from HRSV(A2)__F_DSCav1_mut7 (opt5)
  source 1..1977: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7017 - RNA, 1977 nt, synthetic construct
  misc_feature 1..1977: note = mRNA product Design e-6 comprising derived and/or modified sequence from HRSV(A2)__F_DSCav1_mut7 (opt6)
  source 1..1977: mol_type = other RNA
gggagagcggctcggccattttgtcccagtcagtccggaggctgcggctgcagaagtaccgcctgcggagtaactgcaaagaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7018 - RNA, 1977 nt, synthetic construct
  misc_feature 1..1977: note = mRNA product Design e-6 comprising derived and/or modified sequence from HRSV(A2)__F_DSCav1_mut7 (opt11)
  source 1..1977: mol_type = other RNA
gggagagcggctcggccattttgtcccagtcagtccggaggctgcggctgcagaagtaccgcctgcggagtaactgcaaagaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7019 - RNA, 2193 nt, synthetic construct
  misc_feature 1..2193: note = mRNA product Design f-1 comprising derived and/or modified sequence from HRSV(A2)__F_DSCav1_mut7 (opt1)
  source 1..2193: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7020 - RNA, 2193 nt, synthetic construct
  misc_feature 1..2193: note = mRNA product Design f-1 comprising derived and/or modified sequence from HRSV(A2)__F_DSCav1_mut7 (opt1)
  source 1..2193: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7021 - RNA, 2193 nt, synthetic construct
  misc_feature 1..2193: note = mRNA product Design f-1 comprising derived and/or modified sequence from HRSV(A2)__F_DSCav1_mut7 (opt2)
  source 1..2193: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7022 - RNA, 2193 nt, synthetic construct
  misc_feature 1..2193: note = mRNA product Design f-1 comprising derived and/or modified sequence from HRSV(A2)__F_DSCav1_mut7 (opt3)
  source 1..2193: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7023 - RNA, 2193 nt, synthetic construct
  misc_feature 1..2193: note = mRNA product Design f-1 comprising derived and/or modified sequence from HRSV(A2)__F_DSCav1_mut7 (opt4)
  source 1..2193: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7024 - RNA, 2193 nt, synthetic construct
  misc_feature 1..2193: note = mRNA product Design f-1 comprising derived and/or modified sequence from HRSV(A2)__F_DSCav1_mut7 (opt5)
  source 1..2193: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7025 - RNA, 2193 nt, synthetic construct
  misc_feature 1..2193: note = mRNA product Design f-1 comprising derived and/or modified sequence from HRSV(A2)__F_DSCav1_mut7 (opt6)
  source 1..2193: mol_type = other RNA
gggagagcggctcggccattttgtcccagtcagtccggaggctgcggctgcagaagtaccgcctgcggagtaactgcaaagaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7026 - RNA, 2193 nt, synthetic construct
  misc_feature 1..2193: note = mRNA product Design f-1 comprising derived and/or modified sequence from HRSV(A2)__F_DSCav1_mut7 (opt11)
  source 1..2193: mol_type = other RNA
gggagagcggctcggccattttgtcccagtcagtccggaggctgcggctgcagaagtaccgcctgcggagtaactgcaaagaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7027 - RNA, 1973 nt, synthetic construct
  misc_feature 1..1973: note = mRNA product Design f-2 comprising derived and/or modified sequence from HRSV(A2)__F_DSCav1_mut7 (opt1)
  source 1..1973: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7028 - RNA, 1973 nt, synthetic construct
  misc_feature 1..1973: note = mRNA product Design f-2 comprising derived and/or modified sequence from HRSV(A2)__F_DSCav1_mut7 (opt1)
  source 1..1973: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7029 - RNA, 1973 nt, synthetic construct
  misc_feature 1..1973: note = mRNA product Design f-2 comprising derived and/or modified sequence from HRSV(A2)__F_DSCav1_mut7 (opt2)
  source 1..1973: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7030 - RNA, 1973 nt, synthetic construct
  misc_feature 1..1973: note = mRNA product Design f-2 comprising derived and/or modified sequence from HRSV(A2)__F_DSCav1_mut7 (opt3)
  source 1..1973: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7031 - RNA, 1973 nt, synthetic construct
  misc_feature 1..1973: note = mRNA product Design f-2 comprising derived and/or modified sequence from HRSV(A2)__F_DSCav1_mut7 (opt4)
  source 1..1973: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7032 - RNA, 1973 nt, synthetic construct
  misc_feature 1..1973: note = mRNA product Design f-2 comprising derived and/or modified sequence from HRSV(A2)__F_DSCav1_mut7 (opt5)
  source 1..1973: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7033 - RNA, 1973 nt, synthetic construct
  misc_feature 1..1973: note = mRNA product Design f-2 comprising derived and/or modified sequence from HRSV(A2)__F_DSCav1_mut7 (opt6)
  source 1..1973: mol_type = other RNA
gggagagcggctcggccattttgtcccagtcagtccggaggctgcggctgcagaagtaccgcctgcggagtaactgcaaagaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7034 - RNA, 1973 nt, synthetic construct
  misc_feature 1..1973: note = mRNA product Design f-2 comprising derived and/or modified sequence from HRSV(A2)__F_DSCav1_mut7 (opt11)
  source 1..1973: mol_type = other RNA
gggagagcggctcggccattttgtcccagtcagtccggaggctgcggctgcagaagtaccgcctgcggagtaactgcaaagaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7035 - RNA, 1964 nt, synthetic construct
  misc_feature 1..1964: note = mRNA product Design f-3 comprising derived and/or modified sequence from HRSV(A2)__F_DSCav1_mut7 (opt1)
  source 1..1964: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7036 - RNA, 1964 nt, synthetic construct
  misc_feature 1..1964: note = mRNA product Design f-3 comprising derived and/or modified sequence from HRSV(A2)__F_DSCav1_mut7 (opt1)
  source 1..1964: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7037 - RNA, 1964 nt, synthetic construct
  misc_feature 1..1964: note = mRNA product Design f-3 comprising derived and/or modified sequence from HRSV(A2)__F_DSCav1_mut7 (opt2)
  source 1..1964: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7038 - RNA, 1964 nt, synthetic construct
  misc_feature 1..1964: note = mRNA product Design f-3 comprising derived and/or modified sequence from HRSV(A2)__F_DSCav1_mut7 (opt3)
  source 1..1964: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7039 - RNA, 1964 nt, synthetic construct
  misc_feature 1..1964: note = mRNA product Design f-3 comprising derived and/or modified sequence from HRSV(A2)__F_DSCav1_mut7 (opt4)
  source 1..1964: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7040 - RNA, 1964 nt, synthetic construct
  misc_feature 1..1964: note = mRNA product Design f-3 comprising derived and/or modified sequence from HRSV(A2)__F_DSCav1_mut7 (opt5)
  source 1..1964: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7041 - RNA, 1964 nt, synthetic construct
  misc_feature 1..1964: note = mRNA product Design f-3 comprising derived and/or modified sequence from HRSV(A2)__F_DSCav1_mut7 (opt6)
  source 1..1964: mol_type = other RNA
gggagagtcccgcagtcggcgtccagcggctctgcttgttcgtgtgtgtgtcgttgcaggccttattcaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7042 - RNA, 1964 nt, synthetic construct
  misc_feature 1..1964: note = mRNA product Design f-3 comprising derived and/or modified sequence from HRSV(A2)__F_DSCav1_mut7 (opt11)
  source 1..1964: mol_type = other RNA
gggagagtcccgcagtcggcgtccagcggctctgcttgttcgtgtgtgtgtcgttgcaggccttattcaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7043 - RNA, 2180 nt, synthetic construct
  misc_feature 1..2180: note = mRNA product Design f-4 comprising derived and/or modified sequence from HRSV(A2)__F_DSCav1_mut7 (opt1)
  source 1..2180: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7044 - RNA, 2180 nt, synthetic construct
  misc_feature 1..2180: note = mRNA product Design f-4 comprising derived and/or modified sequence from HRSV(A2)__F_DSCav1_mut7 (opt1)
  source 1..2180: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7045 - RNA, 2180 nt, synthetic construct
  misc_feature 1..2180: note = mRNA product Design f-4 comprising derived and/or modified sequence from HRSV(A2)__F_DSCav1_mut7 (opt2)
  source 1..2180: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7046 - RNA, 2180 nt, synthetic construct
  misc_feature 1..2180: note = mRNA product Design f-4 comprising derived and/or modified sequence from HRSV(A2)__F_DSCav1_mut7 (opt3)
  source 1..2180: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7047 - RNA, 2180 nt, synthetic construct
  misc_feature 1..2180: note = mRNA product Design f-4 comprising derived and/or modified sequence from HRSV(A2)__F_DSCav1_mut7 (opt4)
  source 1..2180: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7048 - RNA, 2180 nt, synthetic construct
  misc_feature 1..2180: note = mRNA product Design f-4 comprising derived and/or modified sequence from HRSV(A2)__F_DSCav1_mut7 (opt5)
  source 1..2180: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7049 - RNA, 2180 nt, synthetic construct
  misc_feature 1..2180: note = mRNA product Design f-4 comprising derived and/or modified sequence from HRSV(A2)__F_DSCav1_mut7 (opt6)
  source 1..2180: mol_type = other RNA
gggagagtcccgcagtcggcgtccagcggctctgcttgttcgtgtgtgtgtcgttgcaggccttattcaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7050 - RNA, 2180 nt, synthetic construct
  misc_feature 1..2180: note = mRNA product Design f-4 comprising derived and/or modified sequence from HRSV(A2)__F_DSCav1_mut7 (opt11)
  source 1..2180: mol_type = other RNA
gggagagtcccgcagtcggcgtccagcggctctgcttgttcgtgtgtgtgtcgttgcaggccttattcaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7051 - RNA, 1956 nt, synthetic construct
  misc_feature 1..1956: note = mRNA product Design f-5 comprising derived and/or modified sequence from HRSV(A2)__F_DSCav1_mut7 (opt1)
  source 1..1956: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7052 - RNA, 1956 nt, synthetic construct
  misc_feature 1..1956: note = mRNA product Design f-5 comprising derived and/or modified sequence from HRSV(A2)__F_DSCav1_mut7 (opt1)
  source 1..1956: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7053 - RNA, 1956 nt, synthetic construct
  misc_feature 1..1956: note = mRNA product Design f-5 comprising derived and/or modified sequence from HRSV(A2)__F_DSCav1_mut7 (opt2)
  source 1..1956: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7054 - RNA, 1956 nt, synthetic construct
  misc_feature 1..1956: note = mRNA product Design f-5 comprising derived and/or modified sequence from HRSV(A2)__F_DSCav1_mut7 (opt3)
  source 1..1956: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7055 - RNA, 1956 nt, synthetic construct
  misc_feature 1..1956: note = mRNA product Design f-5 comprising derived and/or modified sequence from HRSV(A2)__F_DSCav1_mut7 (opt4)
  source 1..1956: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7056 - RNA, 1956 nt, synthetic construct
  misc_feature 1..1956: note = mRNA product Design f-5 comprising derived and/or modified sequence from HRSV(A2)__F_DSCav1_mut7 (opt5)
  source 1..1956: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7057 - RNA, 1956 nt, synthetic construct
  misc_feature 1..1956: note = mRNA product Design f-5 comprising derived and/or modified sequence from HRSV(A2)__F_DSCav1_mut7 (opt6)
  source 1..1956: mol_type = other RNA
gggagactttcccattctgtagcagaatttggtgttgcctgtggtcttggtcccgcggagaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7058 - RNA, 1956 nt, synthetic construct
  misc_feature 1..1956: note = mRNA product Design f-5 comprising derived and/or modified sequence from HRSV(A2)__F_DSCav1_mut7 (opt11)
  source 1..1956: mol_type = other RNA
gggagactttcccattctgtagcagaatttggtgttgcctgtggtcttggtcccgcggagaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7059 - RNA, 1952 nt, synthetic construct
  misc_feature 1..1952: note = mRNA product Design g-1 comprising derived and/or modified sequence from HRSV(A2)__F_DSCav1_mut7 (opt1)
  source 1..1952: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7060 - RNA, 1952 nt, synthetic construct
  misc_feature 1..1952: note = mRNA product Design g-1 comprising derived and/or modified sequence from HRSV(A2)__F_DSCav1_mut7 (opt1)
  source 1..1952: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7061 - RNA, 1952 nt, synthetic construct
  misc_feature 1..1952: note = mRNA product Design g-1 comprising derived and/or modified sequence from HRSV(A2)__F_DSCav1_mut7 (opt2)
  source 1..1952: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7062 - RNA, 1952 nt, synthetic construct
  misc_feature 1..1952: note = mRNA product Design g-1 comprising derived and/or modified sequence from HRSV(A2)__F_DSCav1_mut7 (opt3)
  source 1..1952: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7063 - RNA, 1952 nt, synthetic construct
  misc_feature 1..1952: note = mRNA product Design g-1 comprising derived and/or modified sequence from HRSV(A2)__F_DSCav1_mut7 (opt4)
  source 1..1952: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7064 - RNA, 1952 nt, synthetic construct
  misc_feature 1..1952: note = mRNA product Design g-1 comprising derived and/or modified sequence from HRSV(A2)__F_DSCav1_mut7 (opt5)
  source 1..1952: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7065 - RNA, 1952 nt, synthetic construct
  misc_feature 1..1952: note = mRNA product Design g-1 comprising derived and/or modified sequence from HRSV(A2)__F_DSCav1_mut7 (opt6)
  source 1..1952: mol_type = other RNA
gggagactttcccattctgtagcagaatttggtgttgcctgtggtcttggtcccgcggagaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7066 - RNA, 1952 nt, synthetic construct
  misc_feature 1..1952: note = mRNA product Design g-1 comprising derived and/or modified sequence from HRSV(A2)__F_DSCav1_mut7 (opt11)
  source 1..1952: mol_type = other RNA
gggagactttcccattctgtagcagaatttggtgttgcctgtggtcttggtcccgcggagaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7067 - RNA, 1967 nt, synthetic construct
  misc_feature 1..1967: note = mRNA product Design g-2 comprising derived and/or modified sequence from HRSV(A2)__F_DSCav1_mut7 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7068 - RNA, 1967 nt, synthetic construct
  misc_feature 1..1967: note = mRNA product Design g-2 comprising derived and/or modified sequence from HRSV(A2)__F_DSCav1_mut7 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7069 - RNA, 1967 nt, synthetic construct
  misc_feature 1..1967: note = mRNA product Design g-2 comprising derived and/or modified sequence from HRSV(A2)__F_DSCav1_mut7 (opt2)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7070 - RNA, 1967 nt, synthetic construct
  misc_feature 1..1967: note = mRNA product Design g-2 comprising derived and/or modified sequence from HRSV(A2)__F_DSCav1_mut7 (opt3)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7071 - RNA, 1967 nt, synthetic construct
  misc_feature 1..1967: note = mRNA product Design g-2 comprising derived and/or modified sequence from HRSV(A2)__F_DSCav1_mut7 (opt4)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7072 - RNA, 1967 nt, synthetic construct
  misc_feature 1..1967: note = mRNA product Design g-2 comprising derived and/or modified sequence from HRSV(A2)__F_DSCav1_mut7 (opt5)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7073 - RNA, 1967 nt, synthetic construct
  misc_feature 1..1967: note = mRNA product Design g-2 comprising derived and/or modified sequence from HRSV(A2)__F_DSCav1_mut7 (opt6)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7074 - RNA, 1967 nt, synthetic construct
  misc_feature 1..1967: note = mRNA product Design g-2 comprising derived and/or modified sequence from HRSV(A2)__F_DSCav1_mut7 (opt11)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7075 - RNA, 2199 nt, synthetic construct
  misc_feature 1..2199: note = mRNA product Design g-3 comprising derived and/or modified sequence from HRSV(A2)__F_DSCav1_mut7 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7076 - RNA, 2199 nt, synthetic construct
  misc_feature 1..2199: note = mRNA product Design g-3 comprising derived and/or modified sequence from HRSV(A2)__F_DSCav1_mut7 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7077 - RNA, 2199 nt, synthetic construct
  misc_feature 1..2199: note = mRNA product Design g-3 comprising derived and/or modified sequence from HRSV(A2)__F_DSCav1_mut7 (opt2)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7078 - RNA, 2199 nt, synthetic construct
  misc_feature 1..2199: note = mRNA product Design g-3 comprising derived and/or modified sequence from HRSV(A2)__F_DSCav1_mut7 (opt3)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7079 - RNA, 2199 nt, synthetic construct
  misc_feature 1..2199: note = mRNA product Design g-3 comprising derived and/or modified sequence from HRSV(A2)__F_DSCav1_mut7 (opt4)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7080 - RNA, 2199 nt, synthetic construct
  misc_feature 1..2199: note = mRNA product Design g-3 comprising derived and/or modified sequence from HRSV(A2)__F_DSCav1_mut7 (opt5)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7081 - RNA, 2199 nt, synthetic construct
  misc_feature 1..2199: note = mRNA product Design g-3 comprising derived and/or modified sequence from HRSV(A2)__F_DSCav1_mut7 (opt6)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7082 - RNA, 2199 nt, synthetic construct
  misc_feature 1..2199: note = mRNA product Design g-3 comprising derived and/or modified sequence from HRSV(A2)__F_DSCav1_mut7 (opt11)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7083 - RNA, 1994 nt, synthetic construct
  misc_feature 1..1994: note = mRNA product Design g-4 comprising derived and/or modified sequence from HRSV(A2)__F_DSCav1_mut7 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7084 - RNA, 1994 nt, synthetic construct
  misc_feature 1..1994: note = mRNA product Design g-4 comprising derived and/or modified sequence from HRSV(A2)__F_DSCav1_mut7 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7085 - RNA, 1994 nt, synthetic construct
  misc_feature 1..1994: note = mRNA product Design g-4 comprising derived and/or modified sequence from HRSV(A2)__F_DSCav1_mut7 (opt2)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7086 - RNA, 1994 nt, synthetic construct
  misc_feature 1..1994: note = mRNA product Design g-4 comprising derived and/or modified sequence from HRSV(A2)__F_DSCav1_mut7 (opt3)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7087 - RNA, 1994 nt, synthetic construct
  misc_feature 1..1994: note = mRNA product Design g-4 comprising derived and/or modified sequence from HRSV(A2)__F_DSCav1_mut7 (opt4)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7088 - RNA, 1994 nt, synthetic construct
  misc_feature 1..1994: note = mRNA product Design g-4 comprising derived and/or modified sequence from HRSV(A2)__F_DSCav1_mut7 (opt5)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7089 - RNA, 1994 nt, synthetic construct
  misc_feature 1..1994: note = mRNA product Design g-4 comprising derived and/or modified sequence from HRSV(A2)__F_DSCav1_mut7 (opt6)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7090 - RNA, 1994 nt, synthetic construct
  misc_feature 1..1994: note = mRNA product Design g-4 comprising derived and/or modified sequence from HRSV(A2)__F_DSCav1_mut7 (opt11)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7091 - RNA, 1970 nt, synthetic construct
  misc_feature 1..1970: note = mRNA product Design g-5 comprising derived and/or modified sequence from HRSV(A2)__F_DSCav1_mut7 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7092 - RNA, 1970 nt, synthetic construct
  misc_feature 1..1970: note = mRNA product Design g-5 comprising derived and/or modified sequence from HRSV(A2)__F_DSCav1_mut7 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7093 - RNA, 1970 nt, synthetic construct
  misc_feature 1..1970: note = mRNA product Design g-5 comprising derived and/or modified sequence from HRSV(A2)__F_DSCav1_mut7 (opt2)
  source 1..1970: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7094 - RNA, 1970 nt, synthetic construct
  misc_feature 1..1970: note = mRNA product Design g-5 comprising derived and/or modified sequence from HRSV(A2)__F_DSCav1_mut7 (opt3)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7095 - RNA, 1970 nt, synthetic construct
  misc_feature 1..1970: note = mRNA product Design g-5 comprising derived and/or modified sequence from HRSV(A2)__F_DSCav1_mut7 (opt4)
  source 1..1970: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7096 - RNA, 1970 nt, synthetic construct
  misc_feature 1..1970: note = mRNA product Design g-5 comprising derived and/or modified sequence from HRSV(A2)__F_DSCav1_mut7 (opt5)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7097 - RNA, 1970 nt, synthetic construct
  misc_feature 1..1970: note = mRNA product Design g-5 comprising derived and/or modified sequence from HRSV(A2)__F_DSCav1_mut7 (opt6)
  source 1..1970: mol_type = other RNA
gggagacccgtgacccggaagttgtacggctacgcgactttccctcccacaaaccctcgcgcccttcctttcctacttgggcccggcagaaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7098 - RNA, 1970 nt, synthetic construct
  misc_feature 1..1970: note = mRNA product Design g-5 comprising derived and/or modified sequence from HRSV(A2)__F_DSCav1_mut7 (opt11)
  source 1..1970: mol_type = other RNA
gggagacccgtgacccggaagttgtacggctacgcgactttccctcccacaaaccctcgcgcccttcctttcctacttgggcccggcagaaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7099 - RNA, 1986 nt, synthetic construct
  misc_feature 1..1986: note = mRNA product Design h-1 comprising derived and/or modified sequence from HRSV(A2)__F_DSCav1_mut7 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7100 - RNA, 1986 nt, synthetic construct
  misc_feature 1..1986: note = mRNA product Design h-1 comprising derived and/or modified sequence from HRSV(A2)__F_DSCav1_mut7 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7101 - RNA, 1986 nt, synthetic construct
  misc_feature 1..1986: note = mRNA product Design h-1 comprising derived and/or modified sequence from HRSV(A2)__F_DSCav1_mut7 (opt2)
  source 1..1986: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7102 - RNA, 1986 nt, synthetic construct
  misc_feature 1..1986: note = mRNA product Design h-1 comprising derived and/or modified sequence from HRSV(A2)__F_DSCav1_mut7 (opt3)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7103 - RNA, 1986 nt, synthetic construct
  misc_feature 1..1986: note = mRNA product Design h-1 comprising derived and/or modified sequence from HRSV(A2)__F_DSCav1_mut7 (opt4)
  source 1..1986: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7104 - RNA, 1986 nt, synthetic construct
  misc_feature 1..1986: note = mRNA product Design h-1 comprising derived and/or modified sequence from HRSV(A2)__F_DSCav1_mut7 (opt5)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7105 - RNA, 1986 nt, synthetic construct
  misc_feature 1..1986: note = mRNA product Design h-1 comprising derived and/or modified sequence from HRSV(A2)__F_DSCav1_mut7 (opt6)
  source 1..1986: mol_type = other RNA
gggagacccgtgacccggaagttgtacggctacgcgactttccctcccacaaaccctcgcgcccttcctttcctacttgggcccggcagaaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7106 - RNA, 1986 nt, synthetic construct
  misc_feature 1..1986: note = mRNA product Design h-1 comprising derived and/or modified sequence from HRSV(A2)__F_DSCav1_mut7 (opt11)
  source 1..1986: mol_type = other RNA
gggagacccgtgacccggaagttgtacggctacgcgactttccctcccacaaaccctcgcgcccttcctttcctacttgggcccggcagaaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7107 - RNA, 2202 nt, synthetic construct
  misc_feature 1..2202: note = mRNA product Design h-2 comprising derived and/or modified sequence from HRSV(A2)__F_DSCav1_mut7 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7108 - RNA, 2202 nt, synthetic construct
  misc_feature 1..2202: note = mRNA product Design h-2 comprising derived and/or modified sequence from HRSV(A2)__F_DSCav1_mut7 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7109 - RNA, 2202 nt, synthetic construct
  misc_feature 1..2202: note = mRNA product Design h-2 comprising derived and/or modified sequence from HRSV(A2)__F_DSCav1_mut7 (opt2)
  source 1..2202: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7110 - RNA, 2202 nt, synthetic construct
  misc_feature 1..2202: note = mRNA product Design h-2 comprising derived and/or modified sequence from HRSV(A2)__F_DSCav1_mut7 (opt3)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7111 - RNA, 2202 nt, synthetic construct
  misc_feature 1..2202: note = mRNA product Design h-2 comprising derived and/or modified sequence from HRSV(A2)__F_DSCav1_mut7 (opt4)
  source 1..2202: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7112 - RNA, 2202 nt, synthetic construct
  misc_feature 1..2202: note = mRNA product Design h-2 comprising derived and/or modified sequence from HRSV(A2)__F_DSCav1_mut7 (opt5)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7113 - RNA, 2202 nt, synthetic construct
  misc_feature 1..2202: note = mRNA product Design h-2 comprising derived and/or modified sequence from HRSV(A2)__F_DSCav1_mut7 (opt6)
  source 1..2202: mol_type = other RNA
gggagacccgtgacccggaagttgtacggctacgcgactttccctcccacaaaccctcgcgcccttcctttcctacttgggcccggcagaaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7114 - RNA, 2202 nt, synthetic construct
  misc_feature 1..2202: note = mRNA product Design h-2 comprising derived and/or modified sequence from HRSV(A2)__F_DSCav1_mut7 (opt11)
  source 1..2202: mol_type = other RNA
gggagacccgtgacccggaagttgtacggctacgcgactttccctcccacaaaccctcgcgcccttcctttcctacttgggcccggcagaaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7115 - RNA, 1982 nt, synthetic construct
  misc_feature 1..1982: note = mRNA product Design h-3 comprising derived and/or modified sequence from HRSV(A2)__F_DSCav1_mut7 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7116 - RNA, 1982 nt, synthetic construct
  misc_feature 1..1982: note = mRNA product Design h-3 comprising derived and/or modified sequence from HRSV(A2)__F_DSCav1_mut7 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7117 - RNA, 1982 nt, synthetic construct
  misc_feature 1..1982: note = mRNA product Design h-3 comprising derived and/or modified sequence from HRSV(A2)__F_DSCav1_mut7 (opt2)
  source 1..1982: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7118 - RNA, 1982 nt, synthetic construct
  misc_feature 1..1982: note = mRNA product Design h-3 comprising derived and/or modified sequence from HRSV(A2)__F_DSCav1_mut7 (opt3)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7119 - RNA, 1982 nt, synthetic construct
  misc_feature 1..1982: note = mRNA product Design h-3 comprising derived and/or modified sequence from HRSV(A2)__F_DSCav1_mut7 (opt4)
  source 1..1982: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7120 - RNA, 1982 nt, synthetic construct
  misc_feature 1..1982: note = mRNA product Design h-3 comprising derived and/or modified sequence from HRSV(A2)__F_DSCav1_mut7 (opt5)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7121 - RNA, 1982 nt, synthetic construct
  misc_feature 1..1982: note = mRNA product Design h-3 comprising derived and/or modified sequence from HRSV(A2)__F_DSCav1_mut7 (opt6)
  source 1..1982: mol_type = other RNA
gggagacccgtgacccggaagttgtacggctacgcgactttccctcccacaaaccctcgcgcccttcctttcctacttgggcccggcagaaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7122 - RNA, 1982 nt, synthetic construct
  misc_feature 1..1982: note = mRNA product Design h-3 comprising derived and/or modified sequence from HRSV(A2)__F_DSCav1_mut7 (opt11)
  source 1..1982: mol_type = other RNA
gggagacccgtgacccggaagttgtacggctacgcgactttccctcccacaaaccctcgcgcccttcctttcctacttgggcccggcagaaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7123 - RNA, 2045 nt, synthetic construct
  misc_feature 1..2045: note = mRNA product Design h-4 comprising derived and/or modified sequence from HRSV(A2)__F_DSCav1_mut7 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7124 - RNA, 2045 nt, synthetic construct
  misc_feature 1..2045: note = mRNA product Design h-4 comprising derived and/or modified sequence from HRSV(A2)__F_DSCav1_mut7 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7125 - RNA, 2045 nt, synthetic construct
  misc_feature 1..2045: note = mRNA product Design h-4 comprising derived and/or modified sequence from HRSV(A2)__F_DSCav1_mut7 (opt2)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7126 - RNA, 2045 nt, synthetic construct
  misc_feature 1..2045: note = mRNA product Design h-4 comprising derived and/or modified sequence from HRSV(A2)__F_DSCav1_mut7 (opt3)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7127 - RNA, 2045 nt, synthetic construct
  misc_feature 1..2045: note = mRNA product Design h-4 comprising derived and/or modified sequence from HRSV(A2)__F_DSCav1_mut7 (opt4)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7128 - RNA, 2045 nt, synthetic construct
  misc_feature 1..2045: note = mRNA product Design h-4 comprising derived and/or modified sequence from HRSV(A2)__F_DSCav1_mut7 (opt5)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7129 - RNA, 2045 nt, synthetic construct
  misc_feature 1..2045: note = mRNA product Design h-4 comprising derived and/or modified sequence from HRSV(A2)__F_DSCav1_mut7 (opt6)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7130 - RNA, 2045 nt, synthetic construct
  misc_feature 1..2045: note = mRNA product Design h-4 comprising derived and/or modified sequence from HRSV(A2)__F_DSCav1_mut7 (opt11)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7131 - RNA, 2061 nt, synthetic construct
  misc_feature 1..2061: note = mRNA product Design h-5 comprising derived and/or modified sequence from HRSV(A2)__F_DSCav1_mut7 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7132 - RNA, 2061 nt, synthetic construct
  misc_feature 1..2061: note = mRNA product Design h-5 comprising derived and/or modified sequence from HRSV(A2)__F_DSCav1_mut7 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7133 - RNA, 2061 nt, synthetic construct
  misc_feature 1..2061: note = mRNA product Design h-5 comprising derived and/or modified sequence from HRSV(A2)__F_DSCav1_mut7 (opt2)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7134 - RNA, 2061 nt, synthetic construct
  misc_feature 1..2061: note = mRNA product Design h-5 comprising derived and/or modified sequence from HRSV(A2)__F_DSCav1_mut7 (opt3)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7135 - RNA, 2061 nt, synthetic construct
  misc_feature 1..2061: note = mRNA product Design h-5 comprising derived and/or modified sequence from HRSV(A2)__F_DSCav1_mut7 (opt4)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7136 - RNA, 2061 nt, synthetic construct
  misc_feature 1..2061: note = mRNA product Design h-5 comprising derived and/or modified sequence from HRSV(A2)__F_DSCav1_mut7 (opt5)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7137 - RNA, 2061 nt, synthetic construct
  misc_feature 1..2061: note = mRNA product Design h-5 comprising derived and/or modified sequence from HRSV(A2)__F_DSCav1_mut7 (opt6)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7138 - RNA, 2061 nt, synthetic construct
  misc_feature 1..2061: note = mRNA product Design h-5 comprising derived and/or modified sequence from HRSV(A2)__F_DSCav1_mut7 (opt11)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7139 - RNA, 1994 nt, synthetic construct
  misc_feature 1..1994: note = mRNA product Design i-1 comprising derived and/or modified sequence from HRSV(A2)__F_DSCav1_mut7 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7140 - RNA, 1994 nt, synthetic construct
  misc_feature 1..1994: note = mRNA product Design i-1 comprising derived and/or modified sequence from HRSV(A2)__F_DSCav1_mut7 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7141 - RNA, 1994 nt, synthetic construct
  misc_feature 1..1994: note = mRNA product Design i-1 comprising derived and/or modified sequence from HRSV(A2)__F_DSCav1_mut7 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7142 - RNA, 1994 nt, synthetic construct
  misc_feature 1..1994: note = mRNA product Design i-1 comprising derived and/or modified sequence from HRSV(A2)__F_DSCav1_mut7 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7143 - RNA, 1994 nt, synthetic construct
  misc_feature 1..1994: note = mRNA product Design i-1 comprising derived and/or modified sequence from HRSV(A2)__F_DSCav1_mut7 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7144 - RNA, 1994 nt, synthetic construct
  misc_feature 1..1994: note = mRNA product Design i-1 comprising derived and/or modified sequence from HRSV(A2)__F_DSCav1_mut7 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7145 - RNA, 1994 nt, synthetic construct
  misc_feature 1..1994: note = mRNA product Design i-1 comprising derived and/or modified sequence from HRSV(A2)__F_DSCav1_mut7 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7146 - RNA, 1994 nt, synthetic construct
  misc_feature 1..1994: note = mRNA product Design i-1 comprising derived and/or modified sequence from HRSV(A2)__F_DSCav1_mut7 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7147 - RNA, 1994 nt, synthetic construct
  misc_feature 1..1994: note = mRNA product Design i-2 comprising derived and/or modified sequence from HRSV(A2)__F_DSCav1_mut7 (opt1)
  source 1..1994: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7148 - RNA, 1994 nt, synthetic construct
  misc_feature 1..1994: note = mRNA product Design i-2 comprising derived and/or modified sequence from HRSV(A2)__F_DSCav1_mut7 (opt1)
  source 1..1994: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7149 - RNA, 1994 nt, synthetic construct
  misc_feature 1..1994: note = mRNA product Design i-2 comprising derived and/or modified sequence from HRSV(A2)__F_DSCav1_mut7 (opt2)
  source 1..1994: mol_type = other RNA
gggagaggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7150 - RNA, 1994 nt, synthetic construct
  misc_feature 1..1994: note = mRNA product Design i-2 comprising derived and/or modified sequence from HRSV(A2)__F_DSCav1_mut7 (opt3)
  source 1..1994: mol_type = other RNA
gggagaggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7151 - RNA, 1994 nt, synthetic construct
  misc_feature 1..1994: note = mRNA product Design i-2 comprising derived and/or modified sequence from HRSV(A2)__F_DSCav1_mut7 (opt4)
  source 1..1994: mol_type = other RNA
gggagaggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7152 - RNA, 1994 nt, synthetic construct
  misc_feature 1..1994: note = mRNA product Design i-2 comprising derived and/or modified sequence from HRSV(A2)__F_DSCav1_mut7 (opt5)
  source 1..1994: mol_type = other RNA
gggagaggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7153 - RNA, 1994 nt, synthetic construct
  misc_feature 1..1994: note = mRNA product Design i-2 comprising derived and/or modified sequence from HRSV(A2)__F_DSCav1_mut7 (opt6)
  source 1..1994: mol_type = other RNA
gggagaggcgctgcctacggaggtggcagccatctccttctcggcatcaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7154 - RNA, 1994 nt, synthetic construct
  misc_feature 1..1994: note = mRNA product Design i-2 comprising derived and/or modified sequence from HRSV(A2)__F_DSCav1_mut7 (opt11)
  source 1..1994: mol_type = other RNA
gggagaggcgctgcctacggaggtggcagccatctccttctcggcatcaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7155 - RNA, 1990 nt, synthetic construct
  misc_feature 1..1990: note = mRNA product Design i-2 comprising derived and/or modified sequence from HRSV(A2)__F_DSCav1_mut7 (opt1)
  source 1..1990: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7156 - RNA, 1990 nt, synthetic construct
  misc_feature 1..1990: note = mRNA product Design i-2 comprising derived and/or modified sequence from HRSV(A2)__F_DSCav1_mut7 (opt1)
  source 1..1990: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7157 - RNA, 1990 nt, synthetic construct
  misc_feature 1..1990: note = mRNA product Design i-2 comprising derived and/or modified sequence from HRSV(A2)__F_DSCav1_mut7 (opt2)
  source 1..1990: mol_type = other RNA
ggggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7158 - RNA, 1990 nt, synthetic construct
  misc_feature 1..1990: note = mRNA product Design i-2 comprising derived and/or modified sequence from HRSV(A2)__F_DSCav1_mut7 (opt3)
  source 1..1990: mol_type = other RNA
ggggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7159 - RNA, 1990 nt, synthetic construct
  misc_feature 1..1990: note = mRNA product Design i-2 comprising derived and/or modified sequence from HRSV(A2)__F_DSCav1_mut7 (opt4)
  source 1..1990: mol_type = other RNA
ggggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7160 - RNA, 1990 nt, synthetic construct
  misc_feature 1..1990: note = mRNA product Design i-2 comprising derived and/or modified sequence from HRSV(A2)__F_DSCav1_mut7 (opt5)
  source 1..1990: mol_type = other RNA
ggggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7161 - RNA, 1990 nt, synthetic construct
  misc_feature 1..1990: note = mRNA product Design i-2 comprising derived and/or modified sequence from HRSV(A2)__F_DSCav1_mut7 (opt6)
  source 1..1990: mol_type = other RNA
ggggcgctgcctacggaggtggcagccatctccttctcggcatcaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7162 - RNA, 1990 nt, synthetic construct
  misc_feature 1..1990: note = mRNA product Design i-2 comprising derived and/or modified sequence from HRSV(A2)__F_DSCav1_mut7 (opt11)
  source 1..1990: mol_type = other RNA
ggggcgctgcctacggaggtggcagccatctccttctcggcatcaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7163 - RNA, 1825 nt, synthetic construct
  misc_feature 1..1825: note = mRNA product Design i-3 comprising derived and/or modified sequence from HRSV(A2)__F_DSCav1_mut7 (opt1)
  source 1..1825: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7164 - RNA, 1825 nt, synthetic construct
  misc_feature 1..1825: note = mRNA product Design i-3 comprising derived and/or modified sequence from HRSV(A2)__F_DSCav1_mut7 (opt1)
  source 1..1825: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctccaccccggtgaccctgagcaaggaccagctgtccgggatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7165 - RNA, 1825 nt, synthetic construct
  misc_feature 1..1825: note = mRNA product Design i-3 comprising derived and/or modified sequence from HRSV(A2)__F_DSCav1_mut7 (opt2)
  source 1..1825: mol_type = other RNA
gggagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7166 - RNA, 1825 nt, synthetic construct
  misc_feature 1..1825: note = mRNA product Design i-3 comprising derived and/or modified sequence from HRSV(A2)__F_DSCav1_mut7 (opt3)
  source 1..1825: mol_type = other RNA
gggagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtctacaccggtgaccttgagcaaagaccagctgtccggcatcaacaatatagctttctcaaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7167 - RNA, 1825 nt, synthetic construct
  misc_feature 1..1825: note = mRNA product Design i-3 comprising derived and/or modified sequence from HRSV(A2)__F_DSCav1_mut7 (opt4)
  source 1..1825: mol_type = other RNA
gggagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7168 - RNA, 1825 nt, synthetic construct
  misc_feature 1..1825: note = mRNA product Design i-3 comprising derived and/or modified sequence from HRSV(A2)__F_DSCav1_mut7 (opt5)
  source 1..1825: mol_type = other RNA
gggagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctccacacctgtgaccctgagcaaagaccagctttctgggatcaacaatattgcgttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7169 - RNA, 1825 nt, synthetic construct
  misc_feature 1..1825: note = mRNA product Design i-3 comprising derived and/or modified sequence from HRSV(A2)__F_DSCav1_mut7 (opt6)
  source 1..1825: mol_type = other RNA
gggagaaagcttaccatggaattactcatactcaaagcaaatgcaattaccactatactcacagctgtaactttttgtttcgcctcaggacaaaacatcacagaagaattttatcaatccacatgctctgccgtatcaaaaggctacctatctgccctaagaacaggttggtacacatctgtaataacaatcgaattatccaacatcaaagaaaacaaatgcaacggcacagacgcaaaagtcaaactcatcaaacaagaattagataaatataaaaacgcagtaacagaactacaaatgctaatgtgctctacacccgccacaggatcaggatccgcaatcgcttctggagtagccgtttgcaaagtattacacctagaaggagaagtaaataaaataaaatccgcactactatcaactaataaagcagtagtatcactttctaatggtgtatcagtattaacattcaaagtcctcgacctaaaaaattacatcgacaaacaactattacccatccttaataaacaatcatgctccatatcaaacatagaaactgtcatggaatttcaacaaaaaaacaatagacttctagaaatcacaagagaattttctgtaaatgcaggagtaactacaccagtatcaacatatatgttaaccaactccgaactactatcactcataaacgacatgccaataacaaacgaccaaaaaaaactaatgtcaaataacgttcaaatagtaagacaacaatcatactcaatcatgtgcataataaaagaagaagttttagcatacgtcgtacaacttcccctatacggagtaatagacaccccttgctggaaactccacacctcaccactatgcactacaaacacaaaagaaggttccaacatctgcttaacaagaaccgatcgaggatggtactgcgacaacgctggttccgtatctttcttcccacaagcagaaacatgcaaagtatgctccaatagagtattctgcgacaccatgaactcactaactctaccatccgaagtaaacctatgcaacgtcgacatatttaatccaaaatatgactgcaaaataatgacttcaaaaacagacgtatcctcatcagtaataacatccttaggagcaatagtatcatgttacggcaagacaaaatgtacagcctcaaacaaaaacaaaggtatcattaaaaccttctccaacggctgcgactacgtatcaaataaaggtgtcgatacagtatcagtaggaaacacactctattacgttaataaacaagaaggaaagtcattatacgtaaaaggagaaccaataatcaatttctacgatcccctagtctttccctcagatgaatttgacgcaagcatctctcaagtcaacgaaaaaataaaccaatccctagccttcataagaaaatcagatgaactacttcataacgtcaacgccggaaaatcaacaaccaacataatgatcactacaatcataattgtaattatagtaatactactatcgctaattgccgttggactactactatattgtaaagcaagatcaacacccgttactctatccaaagatcaattatcaggaatcaacaacatagccttctcaaattaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7170 - RNA, 1825 nt, synthetic construct
  misc_feature 1..1825: note = mRNA product Design i-3 comprising derived and/or modified sequence from HRSV(A2)__F_DSCav1_mut7 (opt11)
  source 1..1825: mol_type = other RNA
gggagaaagcttaccatggaactactcatacttaaagccaacgcaataaccacaatcctcaccgccgtcacattctgcttcgcctcgggacaaaacataaccgaagaattttaccagtctacctgctccgccgtctccaagggttacctctccgcgctccgcaccgggtggtacaccagcgttatcaccatcgaactatctaacataaaagaaaacaagtgcaacggaaccgacgcaaaagtcaaactcatcaaacaagaactagacaaatacaagaatgccgtcaccgaactacaaatgctcatgtgctccacccccgccaccggatccggctccgccattgcctccggcgtcgccgtatgcaaagtccttcacttggaaggagaagttaacaaaataaaaagcgccctcctgtcgaccaacaaagcggtggtcagcctctccaacggcgtctctgtcctcaccttcaaagtcctcgacctcaagaactacatagataaacaactactccccatcctaaacaaacagtcatgcagcatatccaacatcgaaaccgtcatggagttccaacagaaaaacaaccgcctccttgaaatcacccgcgagttctctgtcaacgccggcgtcaccacccccgtctccacctacatgctcacaaactccgaactcctcagcctcatcaacgacatgccaatcaccaacgaccaaaagaaactcatgtccaacaacgtacaaatcgttcgtcaacaatcatactcaatcatgtgcatcattaaagaagaagtcctcgcatacgtcgtccaactccccctctatggggtcatcgacaccccatgctggaaactccacacctctcccctatgcaccaccaacaccaaagaaggctccaacatctgcctaacccgaaccgaccgcggatggtactgcgacaacgccggctccgtctccttcttcccccaggccgaaacatgtaaagtctgctccaaccgtgtgttctgcgacaccatgaactcactaaccctcccctccgaagtcaacctctgcaacgtcgacatcttcaacccgaaatacgactgcaaaataatgaccagcaaaacagacgtatcctctagcgtcattaccagcctaggtgcaatcgtgtcctgctacggcaaaacaaaatgcaccgcctccaacaaaaataaaggaatcataaaaaccttctccaacggctgcgactacgtcagcaacaaaggagtcgacaccgtctccgtaggaaatactctatactatgtcaacaaacaagagggtaaatccctctacgtcaaaggcgaacccatcatcaacttctacgaccccctcgtcttcccctctgacgagttcgacgccagcatatcacaagtaaacgaaaagatcaaccaatccctcgcattcattcgcaaatccgacgaactcctacacaacgtcaacgccggaaaatccaccaccaacatcatgatcactactatcattatcgtcatcatcgtcatcctcctctccctcatcgcagtcggccttctactctactgcaaggcacgctctacacccgtaaccctgtctaaagaccaactctccggcatcaacaacatcgctttctccaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7171 - protein, 514 aa, synthetic construct
  REGION 1..514: note = derived and/or modified protein sequence (artificial) from HRSV(A2)__F-del_DSCav1_mut7
MELLILKANAITTILTAVTFCFASGQNITEEFYQSTCSAVSKGYLSALRTGWYTSVITIELSNIKENKCNGTDAKVKLIKQELDKYKNAVTELQMLMCSTPATGSGSAIASGVAVCKVLHLEGEVNKIKSALLSTNKAVVSLSNGVSVLTFKVLDLKNYIDKQLLPILNKQSCSISNIETVMEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVCSNRVFCDTMNSLTLPSEVNLCNVDIFNPKYDCKIMTSKTDVSSSVITSLGAIVSCYGKTKCTASNKNKGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 7172 - RNA, 1545 nt, synthetic construct
  misc_feature 1..1545: note = derived and/or modified CDS sequence (opt1) from HRSV(A2)__F-del_DSCav1_mut7
  source 1..1545: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtga

SEQ ID NO: 7173 - RNA, 1545 nt, synthetic construct
  misc_feature 1..1545: note = derived and/or modified CDS sequence (opt1) from HRSV(A2)__F-del_DSCav1_mut7
  source 1..1545: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctga

SEQ ID NO: 7174 - RNA, 1545 nt, synthetic construct
  misc_feature 1..1545: note = derived and/or modified CDS sequence (opt2) from HRSV(A2)__F-del_DSCav1_mut7
  source 1..1545: mol_type = other RNA
atggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctga

SEQ ID NO: 7175 - RNA, 1545 nt, synthetic construct
  misc_feature 1..1545: note = derived and/or modified CDS sequence (opt3) from HRSV(A2)__F-del_DSCav1_mut7
  source 1..1545: mol_type = other RNA
atggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtga

SEQ ID NO: 7176 - RNA, 1545 nt, synthetic construct
  misc_feature 1..1545: note = derived and/or modified CDS sequence (opt4) from HRSV(A2)__F-del_DSCav1_mut7
  source 1..1545: mol_type = other RNA
atggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatga

SEQ ID NO: 7177 - RNA, 1545 nt, synthetic construct
  misc_feature 1..1545: note = derived and/or modified CDS sequence (opt5) from HRSV(A2)__F-del_DSCav1_mut7
  source 1..1545: mol_type = other RNA
atggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctga

SEQ ID NO: 7178 - RNA, 1545 nt, synthetic construct
  misc_feature 1..1545: note = derived and/or modified CDS sequence (opt6) from HRSV(A2)__F-del_DSCav1_mut7
  source 1..1545: mol_type = other RNA
atggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataa

SEQ ID NO: 7179 - RNA, 1545 nt, synthetic construct
  misc_feature 1..1545: note = derived and/or modified CDS sequence (opt11) from HRSV(A2)__F-del_DSCav1_mut7
  source 1..1545: mol_type = other RNA
atggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaa

SEQ ID NO: 7180 - RNA, 1821 nt, synthetic construct
  misc_feature 1..1821: note = mRNA product Design a-1 comprising derived and/or modified sequence from HRSV(A2)__F-del_DSCav1_mut7 (opt1)
  source 1..1821: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7181 - RNA, 1821 nt, synthetic construct
  misc_feature 1..1821: note = mRNA product Design a-1 comprising derived and/or modified sequence from HRSV(A2)__F-del_DSCav1_mut7 (opt1)
  source 1..1821: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7182 - RNA, 1821 nt, synthetic construct
  misc_feature 1..1821: note = mRNA product Design a-1 comprising derived and/or modified sequence from HRSV(A2)__F-del_DSCav1_mut7 (opt2)
  source 1..1821: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7183 - RNA, 1821 nt, synthetic construct
  misc_feature 1..1821: note = mRNA product Design a-1 comprising derived and/or modified sequence from HRSV(A2)__F-del_DSCav1_mut7 (opt3)
  source 1..1821: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7184 - RNA, 1821 nt, synthetic construct
  misc_feature 1..1821: note = mRNA product Design a-1 comprising derived and/or modified sequence from HRSV(A2)__F-del_DSCav1_mut7 (opt4)
  source 1..1821: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7185 - RNA, 1821 nt, synthetic construct
  misc_feature 1..1821: note = mRNA product Design a-1 comprising derived and/or modified sequence from HRSV(A2)__F-del_DSCav1_mut7 (opt5)
  source 1..1821: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7186 - RNA, 1821 nt, synthetic construct
  misc_feature 1..1821: note = mRNA product Design a-1 comprising derived and/or modified sequence from HRSV(A2)__F-del_DSCav1_mut7 (opt6)
  source 1..1821: mol_type = other RNA
gggagagtcccgcagtcggcgtccagcggctctgcttgttcgtgtgtgtgtcgttgcaggccttattcaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7187 - RNA, 1821 nt, synthetic construct
  misc_feature 1..1821: note = mRNA product Design a-1 comprising derived and/or modified sequence from HRSV(A2)__F-del_DSCav1_mut7 (opt11)
  source 1..1821: mol_type = other RNA
gggagagtcccgcagtcggcgtccagcggctctgcttgttcgtgtgtgtgtcgttgcaggccttattcaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7188 - RNA, 1840 nt, synthetic construct
  misc_feature 1..1840: note = mRNA product Design a-2 comprising derived and/or modified sequence from HRSV(A2)__F-del_DSCav1_mut7 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7189 - RNA, 1840 nt, synthetic construct
  misc_feature 1..1840: note = mRNA product Design a-2 comprising derived and/or modified sequence from HRSV(A2)__F-del_DSCav1_mut7 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7190 - RNA, 1840 nt, synthetic construct
  misc_feature 1..1840: note = mRNA product Design a-2 comprising derived and/or modified sequence from HRSV(A2)__F-del_DSCav1_mut7 (opt2)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7191 - RNA, 1840 nt, synthetic construct
  misc_feature 1..1840: note = mRNA product Design a-2 comprising derived and/or modified sequence from HRSV(A2)__F-del_DSCav1_mut7 (opt3)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7192 - RNA, 1840 nt, synthetic construct
  misc_feature 1..1840: note = mRNA product Design a-2 comprising derived and/or modified sequence from HRSV(A2)__F-del_DSCav1_mut7 (opt4)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7193 - RNA, 1840 nt, synthetic construct
  misc_feature 1..1840: note = mRNA product Design a-2 comprising derived and/or modified sequence from HRSV(A2)__F-del_DSCav1_mut7 (opt5)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7194 - RNA, 1840 nt, synthetic construct
  misc_feature 1..1840: note = mRNA product Design a-2 comprising derived and/or modified sequence from HRSV(A2)__F-del_DSCav1_mut7 (opt6)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7195 - RNA, 1840 nt, synthetic construct
  misc_feature 1..1840: note = mRNA product Design a-2 comprising derived and/or modified sequence from HRSV(A2)__F-del_DSCav1_mut7 (opt11)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7196 - RNA, 1918 nt, synthetic construct
  misc_feature 1..1918: note = mRNA product Design a-3 comprising derived and/or modified sequence from HRSV(A2)__F-del_DSCav1_mut7 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7197 - RNA, 1918 nt, synthetic construct
  misc_feature 1..1918: note = mRNA product Design a-3 comprising derived and/or modified sequence from HRSV(A2)__F-del_DSCav1_mut7 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7198 - RNA, 1918 nt, synthetic construct
  misc_feature 1..1918: note = mRNA product Design a-3 comprising derived and/or modified sequence from HRSV(A2)__F-del_DSCav1_mut7 (opt2)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7199 - RNA, 1918 nt, synthetic construct
  misc_feature 1..1918: note = mRNA product Design a-3 comprising derived and/or modified sequence from HRSV(A2)__F-del_DSCav1_mut7 (opt3)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7200 - RNA, 1918 nt, synthetic construct
  misc_feature 1..1918: note = mRNA product Design a-3 comprising derived and/or modified sequence from HRSV(A2)__F-del_DSCav1_mut7 (opt4)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7201 - RNA, 1918 nt, synthetic construct
  misc_feature 1..1918: note = mRNA product Design a-3 comprising derived and/or modified sequence from HRSV(A2)__F-del_DSCav1_mut7 (opt5)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7202 - RNA, 1918 nt, synthetic construct
  misc_feature 1..1918: note = mRNA product Design a-3 comprising derived and/or modified sequence from HRSV(A2)__F-del_DSCav1_mut7 (opt6)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7203 - RNA, 1918 nt, synthetic construct
  misc_feature 1..1918: note = mRNA product Design a-3 comprising derived and/or modified sequence from HRSV(A2)__F-del_DSCav1_mut7 (opt11)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7204 - RNA, 1867 nt, synthetic construct
  misc_feature 1..1867: note = mRNA product Design a-4 comprising derived and/or modified sequence from HRSV(A2)__F-del_DSCav1_mut7 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7205 - RNA, 1867 nt, synthetic construct
  misc_feature 1..1867: note = mRNA product Design a-4 comprising derived and/or modified sequence from HRSV(A2)__F-del_DSCav1_mut7 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7206 - RNA, 1867 nt, synthetic construct
  misc_feature 1..1867: note = mRNA product Design a-4 comprising derived and/or modified sequence from HRSV(A2)__F-del_DSCav1_mut7 (opt2)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7207 - RNA, 1867 nt, synthetic construct
  misc_feature 1..1867: note = mRNA product Design a-4 comprising derived and/or modified sequence from HRSV(A2)__F-del_DSCav1_mut7 (opt3)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7208 - RNA, 1867 nt, synthetic construct
  misc_feature 1..1867: note = mRNA product Design a-4 comprising derived and/or modified sequence from HRSV(A2)__F-del_DSCav1_mut7 (opt4)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7209 - RNA, 1867 nt, synthetic construct
  misc_feature 1..1867: note = mRNA product Design a-4 comprising derived and/or modified sequence from HRSV(A2)__F-del_DSCav1_mut7 (opt5)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7210 - RNA, 1867 nt, synthetic construct
  misc_feature 1..1867: note = mRNA product Design a-4 comprising derived and/or modified sequence from HRSV(A2)__F-del_DSCav1_mut7 (opt6)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7211 - RNA, 1867 nt, synthetic construct
  misc_feature 1..1867: note = mRNA product Design a-4 comprising derived and/or modified sequence from HRSV(A2)__F-del_DSCav1_mut7 (opt11)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7212 - RNA, 1813 nt, synthetic construct
  misc_feature 1..1813: note = mRNA product Design a-5 comprising derived and/or modified sequence from HRSV(A2)__F-del_DSCav1_mut7 (opt1)
  source 1..1813: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7213 - RNA, 1813 nt, synthetic construct
  misc_feature 1..1813: note = mRNA product Design a-5 comprising derived and/or modified sequence from HRSV(A2)__F-del_DSCav1_mut7 (opt1)
  source 1..1813: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7214 - RNA, 1813 nt, synthetic construct
  misc_feature 1..1813: note = mRNA product Design a-5 comprising derived and/or modified sequence from HRSV(A2)__F-del_DSCav1_mut7 (opt2)
  source 1..1813: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7215 - RNA, 1813 nt, synthetic construct
  misc_feature 1..1813: note = mRNA product Design a-5 comprising derived and/or modified sequence from HRSV(A2)__F-del_DSCav1_mut7 (opt3)
  source 1..1813: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7216 - RNA, 1813 nt, synthetic construct
  misc_feature 1..1813: note = mRNA product Design a-5 comprising derived and/or modified sequence from HRSV(A2)__F-del_DSCav1_mut7 (opt4)
  source 1..1813: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7217 - RNA, 1813 nt, synthetic construct
  misc_feature 1..1813: note = mRNA product Design a-5 comprising derived and/or modified sequence from HRSV(A2)__F-del_DSCav1_mut7 (opt5)
  source 1..1813: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7218 - RNA, 1813 nt, synthetic construct
  misc_feature 1..1813: note = mRNA product Design a-5 comprising derived and/or modified sequence from HRSV(A2)__F-del_DSCav1_mut7 (opt6)
  source 1..1813: mol_type = other RNA
gggagactttcccattctgtagcagaatttggtgttgcctgtggtcttggtcccgcggagaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7219 - RNA, 1813 nt, synthetic construct
  misc_feature 1..1813: note = mRNA product Design a-5 comprising derived and/or modified sequence from HRSV(A2)__F-del_DSCav1_mut7 (opt11)
  source 1..1813: mol_type = other RNA
gggagactttcccattctgtagcagaatttggtgttgcctgtggtcttggtcccgcggagaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7220 - RNA, 1994 nt, synthetic construct
  misc_feature 1..1994: note = mRNA product Design b-1 comprising derived and/or modified sequence from HRSV(A2)__F-del_DSCav1_mut7 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7221 - RNA, 1994 nt, synthetic construct
  misc_feature 1..1994: note = mRNA product Design b-1 comprising derived and/or modified sequence from HRSV(A2)__F-del_DSCav1_mut7 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7222 - RNA, 1994 nt, synthetic construct
  misc_feature 1..1994: note = mRNA product Design b-1 comprising derived and/or modified sequence from HRSV(A2)__F-del_DSCav1_mut7 (opt2)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7223 - RNA, 1994 nt, synthetic construct
  misc_feature 1..1994: note = mRNA product Design b-1 comprising derived and/or modified sequence from HRSV(A2)__F-del_DSCav1_mut7 (opt3)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7224 - RNA, 1994 nt, synthetic construct
  misc_feature 1..1994: note = mRNA product Design b-1 comprising derived and/or modified sequence from HRSV(A2)__F-del_DSCav1_mut7 (opt4)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7225 - RNA, 1994 nt, synthetic construct
  misc_feature 1..1994: note = mRNA product Design b-1 comprising derived and/or modified sequence from HRSV(A2)__F-del_DSCav1_mut7 (opt5)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7226 - RNA, 1994 nt, synthetic construct
  misc_feature 1..1994: note = mRNA product Design b-1 comprising derived and/or modified sequence from HRSV(A2)__F-del_DSCav1_mut7 (opt6)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7227 - RNA, 1994 nt, synthetic construct
  misc_feature 1..1994: note = mRNA product Design b-1 comprising derived and/or modified sequence from HRSV(A2)__F-del_DSCav1_mut7 (opt11)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7228 - RNA, 1814 nt, synthetic construct
  misc_feature 1..1814: note = mRNA product Design b-2 comprising derived and/or modified sequence from HRSV(A2)__F-del_DSCav1_mut7 (opt1)
  source 1..1814: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7229 - RNA, 1814 nt, synthetic construct
  misc_feature 1..1814: note = mRNA product Design b-2 comprising derived and/or modified sequence from HRSV(A2)__F-del_DSCav1_mut7 (opt1)
  source 1..1814: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7230 - RNA, 1814 nt, synthetic construct
  misc_feature 1..1814: note = mRNA product Design b-2 comprising derived and/or modified sequence from HRSV(A2)__F-del_DSCav1_mut7 (opt2)
  source 1..1814: mol_type = other RNA
gggagagcctctgctggagtccggggagtggcgttggctgctagagcgaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7231 - RNA, 1814 nt, synthetic construct
  misc_feature 1..1814: note = mRNA product Design b-2 comprising derived and/or modified sequence from HRSV(A2)__F-del_DSCav1_mut7 (opt3)
  source 1..1814: mol_type = other RNA
gggagagcctctgctggagtccggggagtggcgttggctgctagagcgaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7232 - RNA, 1814 nt, synthetic construct
  misc_feature 1..1814: note = mRNA product Design b-2 comprising derived and/or modified sequence from HRSV(A2)__F-del_DSCav1_mut7 (opt4)
  source 1..1814: mol_type = other RNA
gggagagcctctgctggagtccggggagtggcgttggctgctagagcgaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7233 - RNA, 1814 nt, synthetic construct
  misc_feature 1..1814: note = mRNA product Design b-2 comprising derived and/or modified sequence from HRSV(A2)__F-del_DSCav1_mut7 (opt5)
  source 1..1814: mol_type = other RNA
gggagagcctctgctggagtccggggagtggcgttggctgctagagcgaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7234 - RNA, 1814 nt, synthetic construct
  misc_feature 1..1814: note = mRNA product Design b-2 comprising derived and/or modified sequence from HRSV(A2)__F-del_DSCav1_mut7 (opt6)
  source 1..1814: mol_type = other RNA
gggagagcctctgctggagtccggggagtggcgttggctgctagagcgaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7235 - RNA, 1814 nt, synthetic construct
  misc_feature 1..1814: note = mRNA product Design b-2 comprising derived and/or modified sequence from HRSV(A2)__F-del_DSCav1_mut7 (opt11)
  source 1..1814: mol_type = other RNA
gggagagcctctgctggagtccggggagtggcgttggctgctagagcgaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7236 - RNA, 1834 nt, synthetic construct
  misc_feature 1..1834: note = mRNA product Design b-3 comprising derived and/or modified sequence from HRSV(A2)__F-del_DSCav1_mut7 (opt1)
  source 1..1834: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7237 - RNA, 1834 nt, synthetic construct
  misc_feature 1..1834: note = mRNA product Design b-3 comprising derived and/or modified sequence from HRSV(A2)__F-del_DSCav1_mut7 (opt1)
  source 1..1834: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7238 - RNA, 1834 nt, synthetic construct
  misc_feature 1..1834: note = mRNA product Design b-3 comprising derived and/or modified sequence from HRSV(A2)__F-del_DSCav1_mut7 (opt2)
  source 1..1834: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7239 - RNA, 1834 nt, synthetic construct
  misc_feature 1..1834: note = mRNA product Design b-3 comprising derived and/or modified sequence from HRSV(A2)__F-del_DSCav1_mut7 (opt3)
  source 1..1834: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7240 - RNA, 1834 nt, synthetic construct
  misc_feature 1..1834: note = mRNA product Design b-3 comprising derived and/or modified sequence from HRSV(A2)__F-del_DSCav1_mut7 (opt4)
  source 1..1834: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7241 - RNA, 1834 nt, synthetic construct
  misc_feature 1..1834: note = mRNA product Design b-3 comprising derived and/or modified sequence from HRSV(A2)__F-del_DSCav1_mut7 (opt5)
  source 1..1834: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7242 - RNA, 1834 nt, synthetic construct
  misc_feature 1..1834: note = mRNA product Design b-3 comprising derived and/or modified sequence from HRSV(A2)__F-del_DSCav1_mut7 (opt6)
  source 1..1834: mol_type = other RNA
gggagagtcccgcagtcggcgtccagcggctctgcttgttcgtgtgtgtgtcgttgcaggccttattcaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7243 - RNA, 1834 nt, synthetic construct
  misc_feature 1..1834: note = mRNA product Design b-3 comprising derived and/or modified sequence from HRSV(A2)__F-del_DSCav1_mut7 (opt11)
  source 1..1834: mol_type = other RNA
gggagagtcccgcagtcggcgtccagcggctctgcttgttcgtgtgtgtgtcgttgcaggccttattcaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7244 - RNA, 1885 nt, synthetic construct
  misc_feature 1..1885: note = mRNA product Design b-4 comprising derived and/or modified sequence from HRSV(A2)__F-del_DSCav1_mut7 (opt1)
  source 1..1885: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7245 - RNA, 1885 nt, synthetic construct
  misc_feature 1..1885: note = mRNA product Design b-4 comprising derived and/or modified sequence from HRSV(A2)__F-del_DSCav1_mut7 (opt1)
  source 1..1885: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7246 - RNA, 1885 nt, synthetic construct
  misc_feature 1..1885: note = mRNA product Design b-4 comprising derived and/or modified sequence from HRSV(A2)__F-del_DSCav1_mut7 (opt2)
  source 1..1885: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7247 - RNA, 1885 nt, synthetic construct
  misc_feature 1..1885: note = mRNA product Design b-4 comprising derived and/or modified sequence from HRSV(A2)__F-del_DSCav1_mut7 (opt3)
  source 1..1885: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7248 - RNA, 1885 nt, synthetic construct
  misc_feature 1..1885: note = mRNA product Design b-4 comprising derived and/or modified sequence from HRSV(A2)__F-del_DSCav1_mut7 (opt4)
  source 1..1885: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7249 - RNA, 1885 nt, synthetic construct
  misc_feature 1..1885: note = mRNA product Design b-4 comprising derived and/or modified sequence from HRSV(A2)__F-del_DSCav1_mut7 (opt5)
  source 1..1885: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7250 - RNA, 1885 nt, synthetic construct
  misc_feature 1..1885: note = mRNA product Design b-4 comprising derived and/or modified sequence from HRSV(A2)__F-del_DSCav1_mut7 (opt6)
  source 1..1885: mol_type = other RNA
gggagagtcccgcagtcggcgtccagcggctctgcttgttcgtgtgtgtgtcgttgcaggccttattcaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7251 - RNA, 1885 nt, synthetic construct
  misc_feature 1..1885: note = mRNA product Design b-4 comprising derived and/or modified sequence from HRSV(A2)__F-del_DSCav1_mut7 (opt11)
  source 1..1885: mol_type = other RNA
gggagagtcccgcagtcggcgtccagcggctctgcttgttcgtgtgtgtgtcgttgcaggccttattcaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7252 - RNA, 1947 nt, synthetic construct
  misc_feature 1..1947: note = mRNA product Design b-5 comprising derived and/or modified sequence from HRSV(A2)__F-del_DSCav1_mut7 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7253 - RNA, 1947 nt, synthetic construct
  misc_feature 1..1947: note = mRNA product Design b-5 comprising derived and/or modified sequence from HRSV(A2)__F-del_DSCav1_mut7 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7254 - RNA, 1947 nt, synthetic construct
  misc_feature 1..1947: note = mRNA product Design b-5 comprising derived and/or modified sequence from HRSV(A2)__F-del_DSCav1_mut7 (opt2)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7255 - RNA, 1947 nt, synthetic construct
  misc_feature 1..1947: note = mRNA product Design b-5 comprising derived and/or modified sequence from HRSV(A2)__F-del_DSCav1_mut7 (opt3)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7256 - RNA, 1947 nt, synthetic construct
  misc_feature 1..1947: note = mRNA product Design b-5 comprising derived and/or modified sequence from HRSV(A2)__F-del_DSCav1_mut7 (opt4)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7257 - RNA, 1947 nt, synthetic construct
  misc_feature 1..1947: note = mRNA product Design b-5 comprising derived and/or modified sequence from HRSV(A2)__F-del_DSCav1_mut7 (opt5)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7258 - RNA, 1947 nt, synthetic construct
  misc_feature 1..1947: note = mRNA product Design b-5 comprising derived and/or modified sequence from HRSV(A2)__F-del_DSCav1_mut7 (opt6)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7259 - RNA, 1947 nt, synthetic construct
  misc_feature 1..1947: note = mRNA product Design b-5 comprising derived and/or modified sequence from HRSV(A2)__F-del_DSCav1_mut7 (opt11)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7260 - RNA, 1853 nt, synthetic construct
  misc_feature 1..1853: note = mRNA product Design c-1 comprising derived and/or modified sequence from HRSV(A2)__F-del_DSCav1_mut7 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7261 - RNA, 1853 nt, synthetic construct
  misc_feature 1..1853: note = mRNA product Design c-1 comprising derived and/or modified sequence from HRSV(A2)__F-del_DSCav1_mut7 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7262 - RNA, 1853 nt, synthetic construct
  misc_feature 1..1853: note = mRNA product Design c-1 comprising derived and/or modified sequence from HRSV(A2)__F-del_DSCav1_mut7 (opt2)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7263 - RNA, 1853 nt, synthetic construct
  misc_feature 1..1853: note = mRNA product Design c-1 comprising derived and/or modified sequence from HRSV(A2)__F-del_DSCav1_mut7 (opt3)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7264 - RNA, 1853 nt, synthetic construct
  misc_feature 1..1853: note = mRNA product Design c-1 comprising derived and/or modified sequence from HRSV(A2)__F-del_DSCav1_mut7 (opt4)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7265 - RNA, 1853 nt, synthetic construct
  misc_feature 1..1853: note = mRNA product Design c-1 comprising derived and/or modified sequence from HRSV(A2)__F-del_DSCav1_mut7 (opt5)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7266 - RNA, 1853 nt, synthetic construct
  misc_feature 1..1853: note = mRNA product Design c-1 comprising derived and/or modified sequence from HRSV(A2)__F-del_DSCav1_mut7 (opt6)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7267 - RNA, 1853 nt, synthetic construct
  misc_feature 1..1853: note = mRNA product Design c-1 comprising derived and/or modified sequence from HRSV(A2)__F-del_DSCav1_mut7 (opt11)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7268 - RNA, 1943 nt, synthetic construct
  misc_feature 1..1943: note = mRNA product Design c-2 comprising derived and/or modified sequence from HRSV(A2)__F-del_DSCav1_mut7 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7269 - RNA, 1943 nt, synthetic construct
  misc_feature 1..1943: note = mRNA product Design c-2 comprising derived and/or modified sequence from HRSV(A2)__F-del_DSCav1_mut7 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7270 - RNA, 1943 nt, synthetic construct
  misc_feature 1..1943: note = mRNA product Design c-2 comprising derived and/or modified sequence from HRSV(A2)__F-del_DSCav1_mut7 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7271 - RNA, 1943 nt, synthetic construct
  misc_feature 1..1943: note = mRNA product Design c-2 comprising derived and/or modified sequence from HRSV(A2)__F-del_DSCav1_mut7 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7272 - RNA, 1943 nt, synthetic construct
  misc_feature 1..1943: note = mRNA product Design c-2 comprising derived and/or modified sequence from HRSV(A2)__F-del_DSCav1_mut7 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7273 - RNA, 1943 nt, synthetic construct
  misc_feature 1..1943: note = mRNA product Design c-2 comprising derived and/or modified sequence from HRSV(A2)__F-del_DSCav1_mut7 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7274 - RNA, 1943 nt, synthetic construct
  misc_feature 1..1943: note = mRNA product Design c-2 comprising derived and/or modified sequence from HRSV(A2)__F-del_DSCav1_mut7 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7275 - RNA, 1943 nt, synthetic construct
  misc_feature 1..1943: note = mRNA product Design c-2 comprising derived and/or modified sequence from HRSV(A2)__F-del_DSCav1_mut7 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7276 - RNA, 1920 nt, synthetic construct
  misc_feature 1..1920: note = mRNA product Design c-3 comprising derived and/or modified sequence from HRSV(A2)__F-del_DSCav1_mut7 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7277 - RNA, 1920 nt, synthetic construct
  misc_feature 1..1920: note = mRNA product Design c-3 comprising derived and/or modified sequence from HRSV(A2)__F-del_DSCav1_mut7 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7278 - RNA, 1920 nt, synthetic construct
  misc_feature 1..1920: note = mRNA product Design c-3 comprising derived and/or modified sequence from HRSV(A2)__F-del_DSCav1_mut7 (opt2)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7279 - RNA, 1920 nt, synthetic construct
  misc_feature 1..1920: note = mRNA product Design c-3 comprising derived and/or modified sequence from HRSV(A2)__F-del_DSCav1_mut7 (opt3)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7280 - RNA, 1920 nt, synthetic construct
  misc_feature 1..1920: note = mRNA product Design c-3 comprising derived and/or modified sequence from HRSV(A2)__F-del_DSCav1_mut7 (opt4)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7281 - RNA, 1920 nt, synthetic construct
  misc_feature 1..1920: note = mRNA product Design c-3 comprising derived and/or modified sequence from HRSV(A2)__F-del_DSCav1_mut7 (opt5)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7282 - RNA, 1920 nt, synthetic construct
  misc_feature 1..1920: note = mRNA product Design c-3 comprising derived and/or modified sequence from HRSV(A2)__F-del_DSCav1_mut7 (opt6)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7283 - RNA, 1920 nt, synthetic construct
  misc_feature 1..1920: note = mRNA product Design c-3 comprising derived and/or modified sequence from HRSV(A2)__F-del_DSCav1_mut7 (opt11)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7284 - RNA, 1916 nt, synthetic construct
  misc_feature 1..1916: note = mRNA product Design c-4 comprising derived and/or modified sequence from HRSV(A2)__F-del_DSCav1_mut7 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7285 - RNA, 1916 nt, synthetic construct
  misc_feature 1..1916: note = mRNA product Design c-4 comprising derived and/or modified sequence from HRSV(A2)__F-del_DSCav1_mut7 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7286 - RNA, 1916 nt, synthetic construct
  misc_feature 1..1916: note = mRNA product Design c-4 comprising derived and/or modified sequence from HRSV(A2)__F-del_DSCav1_mut7 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7287 - RNA, 1916 nt, synthetic construct
  misc_feature 1..1916: note = mRNA product Design c-4 comprising derived and/or modified sequence from HRSV(A2)__F-del_DSCav1_mut7 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7288 - RNA, 1916 nt, synthetic construct
  misc_feature 1..1916: note = mRNA product Design c-4 comprising derived and/or modified sequence from HRSV(A2)__F-del_DSCav1_mut7 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7289 - RNA, 1916 nt, synthetic construct
  misc_feature 1..1916: note = mRNA product Design c-4 comprising derived and/or modified sequence from HRSV(A2)__F-del_DSCav1_mut7 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7290 - RNA, 1916 nt, synthetic construct
  misc_feature 1..1916: note = mRNA product Design c-4 comprising derived and/or modified sequence from HRSV(A2)__F-del_DSCav1_mut7 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7291 - RNA, 1916 nt, synthetic construct
  misc_feature 1..1916: note = mRNA product Design c-4 comprising derived and/or modified sequence from HRSV(A2)__F-del_DSCav1_mut7 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7292 - RNA, 1834 nt, synthetic construct
  misc_feature 1..1834: note = mRNA product Design c-5 comprising derived and/or modified sequence from HRSV(A2)__F-del_DSCav1_mut7 (opt1)
  source 1..1834: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7293 - RNA, 1834 nt, synthetic construct
  misc_feature 1..1834: note = mRNA product Design c-5 comprising derived and/or modified sequence from HRSV(A2)__F-del_DSCav1_mut7 (opt1)
  source 1..1834: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7294 - RNA, 1834 nt, synthetic construct
  misc_feature 1..1834: note = mRNA product Design c-5 comprising derived and/or modified sequence from HRSV(A2)__F-del_DSCav1_mut7 (opt2)
  source 1..1834: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7295 - RNA, 1834 nt, synthetic construct
  misc_feature 1..1834: note = mRNA product Design c-5 comprising derived and/or modified sequence from HRSV(A2)__F-del_DSCav1_mut7 (opt3)
  source 1..1834: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7296 - RNA, 1834 nt, synthetic construct
  misc_feature 1..1834: note = mRNA product Design c-5 comprising derived and/or modified sequence from HRSV(A2)__F-del_DSCav1_mut7 (opt4)
  source 1..1834: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7297 - RNA, 1834 nt, synthetic construct
  misc_feature 1..1834: note = mRNA product Design c-5 comprising derived and/or modified sequence from HRSV(A2)__F-del_DSCav1_mut7 (opt5)
  source 1..1834: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7298 - RNA, 1834 nt, synthetic construct
  misc_feature 1..1834: note = mRNA product Design c-5 comprising derived and/or modified sequence from HRSV(A2)__F-del_DSCav1_mut7 (opt6)
  source 1..1834: mol_type = other RNA
gggagagcggctcggccattttgtcccagtcagtccggaggctgcggctgcagaagtaccgcctgcggagtaactgcaaagaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7299 - RNA, 1834 nt, synthetic construct
  misc_feature 1..1834: note = mRNA product Design c-5 comprising derived and/or modified sequence from HRSV(A2)__F-del_DSCav1_mut7 (opt11)
  source 1..1834: mol_type = other RNA
gggagagcggctcggccattttgtcccagtcagtccggaggctgcggctgcagaagtaccgcctgcggagtaactgcaaagaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7300 - RNA, 1843 nt, synthetic construct
  misc_feature 1..1843: note = mRNA product Design d-1 comprising derived and/or modified sequence from HRSV(A2)__F-del_DSCav1_mut7 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7301 - RNA, 1843 nt, synthetic construct
  misc_feature 1..1843: note = mRNA product Design d-1 comprising derived and/or modified sequence from HRSV(A2)__F-del_DSCav1_mut7 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7302 - RNA, 1843 nt, synthetic construct
  misc_feature 1..1843: note = mRNA product Design d-1 comprising derived and/or modified sequence from HRSV(A2)__F-del_DSCav1_mut7 (opt2)
  source 1..1843: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7303 - RNA, 1843 nt, synthetic construct
  misc_feature 1..1843: note = mRNA product Design d-1 comprising derived and/or modified sequence from HRSV(A2)__F-del_DSCav1_mut7 (opt3)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7304 - RNA, 1843 nt, synthetic construct
  misc_feature 1..1843: note = mRNA product Design d-1 comprising derived and/or modified sequence from HRSV(A2)__F-del_DSCav1_mut7 (opt4)
  source 1..1843: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7305 - RNA, 1843 nt, synthetic construct
  misc_feature 1..1843: note = mRNA product Design d-1 comprising derived and/or modified sequence from HRSV(A2)__F-del_DSCav1_mut7 (opt5)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7306 - RNA, 1843 nt, synthetic construct
  misc_feature 1..1843: note = mRNA product Design d-1 comprising derived and/or modified sequence from HRSV(A2)__F-del_DSCav1_mut7 (opt6)
  source 1..1843: mol_type = other RNA
gggagacccgtgacccggaagttgtacggctacgcgactttccctcccacaaaccctcgcgcccttcctttcctacttgggcccggcagaaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7307 - RNA, 1843 nt, synthetic construct
  misc_feature 1..1843: note = mRNA product Design d-1 comprising derived and/or modified sequence from HRSV(A2)__F-del_DSCav1_mut7 (opt11)
  source 1..1843: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7308 - RNA, 1898 nt, synthetic construct
  misc_feature 1..1898: note = mRNA product Design d-2 comprising derived and/or modified sequence from HRSV(A2)__F-del_DSCav1_mut7 (opt1)
  source 1..1898: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7309 - RNA, 1898 nt, synthetic construct
  misc_feature 1..1898: note = mRNA product Design d-2 comprising derived and/or modified sequence from HRSV(A2)__F-del_DSCav1_mut7 (opt1)
  source 1..1898: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7310 - RNA, 1898 nt, synthetic construct
  misc_feature 1..1898: note = mRNA product Design d-2 comprising derived and/or modified sequence from HRSV(A2)__F-del_DSCav1_mut7 (opt2)
  source 1..1898: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7311 - RNA, 1898 nt, synthetic construct
  misc_feature 1..1898: note = mRNA product Design d-2 comprising derived and/or modified sequence from HRSV(A2)__F-del_DSCav1_mut7 (opt3)
  source 1..1898: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7312 - RNA, 1898 nt, synthetic construct
  misc_feature 1..1898: note = mRNA product Design d-2 comprising derived and/or modified sequence from HRSV(A2)__F-del_DSCav1_mut7 (opt4)
  source 1..1898: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7313 - RNA, 1898 nt, synthetic construct
  misc_feature 1..1898: note = mRNA product Design d-2 comprising derived and/or modified sequence from HRSV(A2)__F-del_DSCav1_mut7 (opt5)
  source 1..1898: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7314 - RNA, 1898 nt, synthetic construct
  misc_feature 1..1898: note = mRNA product Design d-2 comprising derived and/or modified sequence from HRSV(A2)__F-del_DSCav1_mut7 (opt6)
  source 1..1898: mol_type = other RNA
gggagagcggctcggccattttgtcccagtcagtccggaggctgcggctgcagaagtaccgcctgcggagtaactgcaaagaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7315 - RNA, 1898 nt, synthetic construct
  misc_feature 1..1898: note = mRNA product Design d-2 comprising derived and/or modified sequence from HRSV(A2)__F-del_DSCav1_mut7 (opt11)
  source 1..1898: mol_type = other RNA
gggagagcggctcggccattttgtcccagtcagtccggaggctgcggctgcagaagtaccgcctgcggagtaactgcaaagaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7316 - RNA, 2214 nt, synthetic construct
  misc_feature 1..2214: note = mRNA product Design d-3 comprising derived and/or modified sequence from HRSV(A2)__F-del_DSCav1_mut7 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7317 - RNA, 2214 nt, synthetic construct
  misc_feature 1..2214: note = mRNA product Design d-3 comprising derived and/or modified sequence from HRSV(A2)__F-del_DSCav1_mut7 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7318 - RNA, 2214 nt, synthetic construct
  misc_feature 1..2214: note = mRNA product Design d-3 comprising derived and/or modified sequence from HRSV(A2)__F-del_DSCav1_mut7 (opt2)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7319 - RNA, 2214 nt, synthetic construct
  misc_feature 1..2214: note = mRNA product Design d-3 comprising derived and/or modified sequence from HRSV(A2)__F-del_DSCav1_mut7 (opt3)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7320 - RNA, 2214 nt, synthetic construct
  misc_feature 1..2214: note = mRNA product Design d-3 comprising derived and/or modified sequence from HRSV(A2)__F-del_DSCav1_mut7 (opt4)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7321 - RNA, 2214 nt, synthetic construct
  misc_feature 1..2214: note = mRNA product Design d-3 comprising derived and/or modified sequence from HRSV(A2)__F-del_DSCav1_mut7 (opt5)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7322 - RNA, 2214 nt, synthetic construct
  misc_feature 1..2214: note = mRNA product Design d-3 comprising derived and/or modified sequence from HRSV(A2)__F-del_DSCav1_mut7 (opt6)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7323 - RNA, 2214 nt, synthetic construct
  misc_feature 1..2214: note = mRNA product Design d-3 comprising derived and/or modified sequence from HRSV(A2)__F-del_DSCav1_mut7 (opt11)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7324 - RNA, 1897 nt, synthetic construct
  misc_feature 1..1897: note = mRNA product Design d-4 comprising derived and/or modified sequence from HRSV(A2)__F-del_DSCav1_mut7 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7325 - RNA, 1897 nt, synthetic construct
  misc_feature 1..1897: note = mRNA product Design d-4 comprising derived and/or modified sequence from HRSV(A2)__F-del_DSCav1_mut7 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7326 - RNA, 1897 nt, synthetic construct
  misc_feature 1..1897: note = mRNA product Design d-4 comprising derived and/or modified sequence from HRSV(A2)__F-del_DSCav1_mut7 (opt2)
  source 1..1897: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7327 - RNA, 1897 nt, synthetic construct
  misc_feature 1..1897: note = mRNA product Design d-4 comprising derived and/or modified sequence from HRSV(A2)__F-del_DSCav1_mut7 (opt3)
  source 1..1897: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7328 - RNA, 1897 nt, synthetic construct
  misc_feature 1..1897: note = mRNA product Design d-4 comprising derived and/or modified sequence from HRSV(A2)__F-del_DSCav1_mut7 (opt4)
  source 1..1897: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7329 - RNA, 1897 nt, synthetic construct
  misc_feature 1..1897: note = mRNA product Design d-4 comprising derived and/or modified sequence from HRSV(A2)__F-del_DSCav1_mut7 (opt5)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7330 - RNA, 1897 nt, synthetic construct
  misc_feature 1..1897: note = mRNA product Design d-4 comprising derived and/or modified sequence from HRSV(A2)__F-del_DSCav1_mut7 (opt6)
  source 1..1897: mol_type = other RNA
gggagagtcccgcagtcggcgtccagcggctctgcttgttcgtgtgtgtgtcgttgcaggccttattcaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7331 - RNA, 1897 nt, synthetic construct
  misc_feature 1..1897: note = mRNA product Design d-4 comprising derived and/or modified sequence from HRSV(A2)__F-del_DSCav1_mut7 (opt11)
  source 1..1897: mol_type = other RNA
gggagagtcccgcagtcggcgtccagcggctctgcttgttcgtgtgtgtgtcgttgcaggccttattcaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7332 - RNA, 1994 nt, synthetic construct
  misc_feature 1..1994: note = mRNA product Design d-5 comprising derived and/or modified sequence from HRSV(A2)__F-del_DSCav1_mut7 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7333 - RNA, 1994 nt, synthetic construct
  misc_feature 1..1994: note = mRNA product Design d-5 comprising derived and/or modified sequence from HRSV(A2)__F-del_DSCav1_mut7 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7334 - RNA, 1994 nt, synthetic construct
  misc_feature 1..1994: note = mRNA product Design d-5 comprising derived and/or modified sequence from HRSV(A2)__F-del_DSCav1_mut7 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7335 - RNA, 1994 nt, synthetic construct
  misc_feature 1..1994: note = mRNA product Design d-5 comprising derived and/or modified sequence from HRSV(A2)__F-del_DSCav1_mut7 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7336 - RNA, 1994 nt, synthetic construct
  misc_feature 1..1994: note = mRNA product Design d-5 comprising derived and/or modified sequence from HRSV(A2)__F-del_DSCav1_mut7 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7337 - RNA, 1994 nt, synthetic construct
  misc_feature 1..1994: note = mRNA product Design d-5 comprising derived and/or modified sequence from HRSV(A2)__F-del_DSCav1_mut7 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7338 - RNA, 1994 nt, synthetic construct
  misc_feature 1..1994: note = mRNA product Design d-5 comprising derived and/or modified sequence from HRSV(A2)__F-del_DSCav1_mut7 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7339 - RNA, 1994 nt, synthetic construct
  misc_feature 1..1994: note = mRNA product Design d-5 comprising derived and/or modified sequence from HRSV(A2)__F-del_DSCav1_mut7 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7340 - RNA, 1874 nt, synthetic construct
  misc_feature 1..1874: note = mRNA product Design e-1 comprising derived and/or modified sequence from HRSV(A2)__F-del_DSCav1_mut7 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7341 - RNA, 1874 nt, synthetic construct
  misc_feature 1..1874: note = mRNA product Design e-1 comprising derived and/or modified sequence from HRSV(A2)__F-del_DSCav1_mut7 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7342 - RNA, 1874 nt, synthetic construct
  misc_feature 1..1874: note = mRNA product Design e-1 comprising derived and/or modified sequence from HRSV(A2)__F-del_DSCav1_mut7 (opt2)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7343 - RNA, 1874 nt, synthetic construct
  misc_feature 1..1874: note = mRNA product Design e-1 comprising derived and/or modified sequence from HRSV(A2)__F-del_DSCav1_mut7 (opt3)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7344 - RNA, 1874 nt, synthetic construct
  misc_feature 1..1874: note = mRNA product Design e-1 comprising derived and/or modified sequence from HRSV(A2)__F-del_DSCav1_mut7 (opt4)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7345 - RNA, 1874 nt, synthetic construct
  misc_feature 1..1874: note = mRNA product Design e-1 comprising derived and/or modified sequence from HRSV(A2)__F-del_DSCav1_mut7 (opt5)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7346 - RNA, 1874 nt, synthetic construct
  misc_feature 1..1874: note = mRNA product Design e-1 comprising derived and/or modified sequence from HRSV(A2)__F-del_DSCav1_mut7 (opt6)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7347 - RNA, 1874 nt, synthetic construct
  misc_feature 1..1874: note = mRNA product Design e-1 comprising derived and/or modified sequence from HRSV(A2)__F-del_DSCav1_mut7 (opt11)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7348 - RNA, 1856 nt, synthetic construct
  misc_feature 1..1856: note = mRNA product Design e-2 comprising derived and/or modified sequence from HRSV(A2)__F-del_DSCav1_mut7 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7349 - RNA, 1856 nt, synthetic construct
  misc_feature 1..1856: note = mRNA product Design e-2 comprising derived and/or modified sequence from HRSV(A2)__F-del_DSCav1_mut7 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7350 - RNA, 1856 nt, synthetic construct
  misc_feature 1..1856: note = mRNA product Design e-2 comprising derived and/or modified sequence from HRSV(A2)__F-del_DSCav1_mut7 (opt2)
  source 1..1856: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7351 - RNA, 1856 nt, synthetic construct
  misc_feature 1..1856: note = mRNA product Design e-2 comprising derived and/or modified sequence from HRSV(A2)__F-del_DSCav1_mut7 (opt3)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7352 - RNA, 1856 nt, synthetic construct
  misc_feature 1..1856: note = mRNA product Design e-2 comprising derived and/or modified sequence from HRSV(A2)__F-del_DSCav1_mut7 (opt4)
  source 1..1856: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7353 - RNA, 1856 nt, synthetic construct
  misc_feature 1..1856: note = mRNA product Design e-2 comprising derived and/or modified sequence from HRSV(A2)__F-del_DSCav1_mut7 (opt5)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7354 - RNA, 1856 nt, synthetic construct
  misc_feature 1..1856: note = mRNA product Design e-2 comprising derived and/or modified sequence from HRSV(A2)__F-del_DSCav1_mut7 (opt6)
  source 1..1856: mol_type = other RNA
gggagacccgtgacccggaagttgtacggctacgcgactttccctcccacaaaccctcgcgcccttcctttcctacttgggcccggcagaaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7355 - RNA, 1856 nt, synthetic construct
  misc_feature 1..1856: note = mRNA product Design e-2 comprising derived and/or modified sequence from HRSV(A2)__F-del_DSCav1_mut7 (opt11)
  source 1..1856: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7356 - RNA, 1826 nt, synthetic construct
  misc_feature 1..1826: note = mRNA product Design e-3 comprising derived and/or modified sequence from HRSV(A2)__F-del_DSCav1_mut7 (opt1)
  source 1..1826: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7357 - RNA, 1826 nt, synthetic construct
  misc_feature 1..1826: note = mRNA product Design e-3 comprising derived and/or modified sequence from HRSV(A2)__F-del_DSCav1_mut7 (opt1)
  source 1..1826: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7358 - RNA, 1826 nt, synthetic construct
  misc_feature 1..1826: note = mRNA product Design e-3 comprising derived and/or modified sequence from HRSV(A2)__F-del_DSCav1_mut7 (opt2)
  source 1..1826: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7359 - RNA, 1826 nt, synthetic construct
  misc_feature 1..1826: note = mRNA product Design e-3 comprising derived and/or modified sequence from HRSV(A2)__F-del_DSCav1_mut7 (opt3)
  source 1..1826: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7360 - RNA, 1826 nt, synthetic construct
  misc_feature 1..1826: note = mRNA product Design e-3 comprising derived and/or modified sequence from HRSV(A2)__F-del_DSCav1_mut7 (opt4)
  source 1..1826: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7361 - RNA, 1826 nt, synthetic construct
  misc_feature 1..1826: note = mRNA product Design e-3 comprising derived and/or modified sequence from HRSV(A2)__F-del_DSCav1_mut7 (opt5)
  source 1..1826: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7362 - RNA, 1826 nt, synthetic construct
  misc_feature 1..1826: note = mRNA product Design e-3 comprising derived and/or modified sequence from HRSV(A2)__F-del_DSCav1_mut7 (opt6)
  source 1..1826: mol_type = other RNA
gggagactttcccattctgtagcagaatttggtgttgcctgtggtcttggtcccgcggagaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7363 - RNA, 1826 nt, synthetic construct
  misc_feature 1..1826: note = mRNA product Design e-3 comprising derived and/or modified sequence from HRSV(A2)__F-del_DSCav1_mut7 (opt11)
  source 1..1826: mol_type = other RNA
gggagactttcccattctgtagcagaatttggtgttgcctgtggtcttggtcccgcggagaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7364 - RNA, 1880 nt, synthetic construct
  misc_feature 1..1880: note = mRNA product Design e-4 comprising derived and/or modified sequence from HRSV(A2)__F-del_DSCav1_mut7 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7365 - RNA, 1880 nt, synthetic construct
  misc_feature 1..1880: note = mRNA product Design e-4 comprising derived and/or modified sequence from HRSV(A2)__F-del_DSCav1_mut7 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7366 - RNA, 1880 nt, synthetic construct
  misc_feature 1..1880: note = mRNA product Design e-4 comprising derived and/or modified sequence from HRSV(A2)__F-del_DSCav1_mut7 (opt2)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7367 - RNA, 1880 nt, synthetic construct
  misc_feature 1..1880: note = mRNA product Design e-4 comprising derived and/or modified sequence from HRSV(A2)__F-del_DSCav1_mut7 (opt3)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7368 - RNA, 1880 nt, synthetic construct
  misc_feature 1..1880: note = mRNA product Design e-4 comprising derived and/or modified sequence from HRSV(A2)__F-del_DSCav1_mut7 (opt4)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7369 - RNA, 1880 nt, synthetic construct
  misc_feature 1..1880: note = mRNA product Design e-4 comprising derived and/or modified sequence from HRSV(A2)__F-del_DSCav1_mut7 (opt5)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7370 - RNA, 1880 nt, synthetic construct
  misc_feature 1..1880: note = mRNA product Design e-4 comprising derived and/or modified sequence from HRSV(A2)__F-del_DSCav1_mut7 (opt6)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7371 - RNA, 1880 nt, synthetic construct
  misc_feature 1..1880: note = mRNA product Design e-4 comprising derived and/or modified sequence from HRSV(A2)__F-del_DSCav1_mut7 (opt11)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7372 - RNA, 1847 nt, synthetic construct
  misc_feature 1..1847: note = mRNA product Design e-5 comprising derived and/or modified sequence from HRSV(A2)__F-del_DSCav1_mut7 (opt1)
  source 1..1847: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7373 - RNA, 1847 nt, synthetic construct
  misc_feature 1..1847: note = mRNA product Design e-5 comprising derived and/or modified sequence from HRSV(A2)__F-del_DSCav1_mut7 (opt1)
  source 1..1847: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7374 - RNA, 1847 nt, synthetic construct
  misc_feature 1..1847: note = mRNA product Design e-5 comprising derived and/or modified sequence from HRSV(A2)__F-del_DSCav1_mut7 (opt2)
  source 1..1847: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7375 - RNA, 1847 nt, synthetic construct
  misc_feature 1..1847: note = mRNA product Design e-5 comprising derived and/or modified sequence from HRSV(A2)__F-del_DSCav1_mut7 (opt3)
  source 1..1847: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7376 - RNA, 1847 nt, synthetic construct
  misc_feature 1..1847: note = mRNA product Design e-5 comprising derived and/or modified sequence from HRSV(A2)__F-del_DSCav1_mut7 (opt4)
  source 1..1847: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7377 - RNA, 1847 nt, synthetic construct
  misc_feature 1..1847: note = mRNA product Design e-5 comprising derived and/or modified sequence from HRSV(A2)__F-del_DSCav1_mut7 (opt5)
  source 1..1847: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7378 - RNA, 1847 nt, synthetic construct
  misc_feature 1..1847: note = mRNA product Design e-5 comprising derived and/or modified sequence from HRSV(A2)__F-del_DSCav1_mut7 (opt6)
  source 1..1847: mol_type = other RNA
gggagagcggctcggccattttgtcccagtcagtccggaggctgcggctgcagaagtaccgcctgcggagtaactgcaaagaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7379 - RNA, 1847 nt, synthetic construct
  misc_feature 1..1847: note = mRNA product Design e-5 comprising derived and/or modified sequence from HRSV(A2)__F-del_DSCav1_mut7 (opt11)
  source 1..1847: mol_type = other RNA
gggagagcggctcggccattttgtcccagtcagtccggaggctgcggctgcagaagtaccgcctgcggagtaactgcaaagaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7380 - RNA, 1914 nt, synthetic construct
  misc_feature 1..1914: note = mRNA product Design e-6 comprising derived and/or modified sequence from HRSV(A2)__F-del_DSCav1_mut7 (opt1)
  source 1..1914: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7381 - RNA, 1914 nt, synthetic construct
  misc_feature 1..1914: note = mRNA product Design e-6 comprising derived and/or modified sequence from HRSV(A2)__F-del_DSCav1_mut7 (opt1)
  source 1..1914: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7382 - RNA, 1914 nt, synthetic construct
  misc_feature 1..1914: note = mRNA product Design e-6 comprising derived and/or modified sequence from HRSV(A2)__F-del_DSCav1_mut7 (opt2)
  source 1..1914: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7383 - RNA, 1914 nt, synthetic construct
  misc_feature 1..1914: note = mRNA product Design e-6 comprising derived and/or modified sequence from HRSV(A2)__F-del_DSCav1_mut7 (opt3)
  source 1..1914: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7384 - RNA, 1914 nt, synthetic construct
  misc_feature 1..1914: note = mRNA product Design e-6 comprising derived and/or modified sequence from HRSV(A2)__F-del_DSCav1_mut7 (opt4)
  source 1..1914: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7385 - RNA, 1914 nt, synthetic construct
  misc_feature 1..1914: note = mRNA product Design e-6 comprising derived and/or modified sequence from HRSV(A2)__F-del_DSCav1_mut7 (opt5)
  source 1..1914: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7386 - RNA, 1914 nt, synthetic construct
  misc_feature 1..1914: note = mRNA product Design e-6 comprising derived and/or modified sequence from HRSV(A2)__F-del_DSCav1_mut7 (opt6)
  source 1..1914: mol_type = other RNA
gggagagcggctcggccattttgtcccagtcagtccggaggctgcggctgcagaagtaccgcctgcggagtaactgcaaagaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7387 - RNA, 1914 nt, synthetic construct
  misc_feature 1..1914: note = mRNA product Design e-6 comprising derived and/or modified sequence from HRSV(A2)__F-del_DSCav1_mut7 (opt11)
  source 1..1914: mol_type = other RNA
gggagagcggctcggccattttgtcccagtcagtccggaggctgcggctgcagaagtaccgcctgcggagtaactgcaaagaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7388 - RNA, 2130 nt, synthetic construct
  misc_feature 1..2130: note = mRNA product Design f-1 comprising derived and/or modified sequence from HRSV(A2)__F-del_DSCav1_mut7 (opt1)
  source 1..2130: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7389 - RNA, 2130 nt, synthetic construct
  misc_feature 1..2130: note = mRNA product Design f-1 comprising derived and/or modified sequence from HRSV(A2)__F-del_DSCav1_mut7 (opt1)
  source 1..2130: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7390 - RNA, 2130 nt, synthetic construct
  misc_feature 1..2130: note = mRNA product Design f-1 comprising derived and/or modified sequence from HRSV(A2)__F-del_DSCav1_mut7 (opt2)
  source 1..2130: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7391 - RNA, 2130 nt, synthetic construct
  misc_feature 1..2130: note = mRNA product Design f-1 comprising derived and/or modified sequence from HRSV(A2)__F-del_DSCav1_mut7 (opt3)
  source 1..2130: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7392 - RNA, 2130 nt, synthetic construct
  misc_feature 1..2130: note = mRNA product Design f-1 comprising derived and/or modified sequence from HRSV(A2)__F-del_DSCav1_mut7 (opt4)
  source 1..2130: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7393 - RNA, 2130 nt, synthetic construct
  misc_feature 1..2130: note = mRNA product Design f-1 comprising derived and/or modified sequence from HRSV(A2)__F-del_DSCav1_mut7 (opt5)
  source 1..2130: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7394 - RNA, 2130 nt, synthetic construct
  misc_feature 1..2130: note = mRNA product Design f-1 comprising derived and/or modified sequence from HRSV(A2)__F-del_DSCav1_mut7 (opt6)
  source 1..2130: mol_type = other RNA
gggagagcggctcggccattttgtcccagtcagtccggaggctgcggctgcagaagtaccgcctgcggagtaactgcaaagaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7395 - RNA, 2130 nt, synthetic construct
  misc_feature 1..2130: note = mRNA product Design f-1 comprising derived and/or modified sequence from HRSV(A2)__F-del_DSCav1_mut7 (opt11)
  source 1..2130: mol_type = other RNA
gggagagcggctcggccattttgtcccagtcagtccggaggctgcggctgcagaagtaccgcctgcggagtaactgcaaagaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7396 - RNA, 1910 nt, synthetic construct
  misc_feature 1..1910: note = mRNA product Design f-2 comprising derived and/or modified sequence from HRSV(A2)__F-del_DSCav1_mut7 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7397 - RNA, 1910 nt, synthetic construct
  misc_feature 1..1910: note = mRNA product Design f-2 comprising derived and/or modified sequence from HRSV(A2)__F-del_DSCav1_mut7 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7398 - RNA, 1910 nt, synthetic construct
  misc_feature 1..1910: note = mRNA product Design f-2 comprising derived and/or modified sequence from HRSV(A2)__F-del_DSCav1_mut7 (opt2)
  source 1..1910: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7399 - RNA, 1910 nt, synthetic construct
  misc_feature 1..1910: note = mRNA product Design f-2 comprising derived and/or modified sequence from HRSV(A2)__F-del_DSCav1_mut7 (opt3)
  source 1..1910: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7400 - RNA, 1910 nt, synthetic construct
  misc_feature 1..1910: note = mRNA product Design f-2 comprising derived and/or modified sequence from HRSV(A2)__F-del_DSCav1_mut7 (opt4)
  source 1..1910: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7401 - RNA, 1910 nt, synthetic construct
  misc_feature 1..1910: note = mRNA product Design f-2 comprising derived and/or modified sequence from HRSV(A2)__F-del_DSCav1_mut7 (opt5)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7402 - RNA, 1910 nt, synthetic construct
  misc_feature 1..1910: note = mRNA product Design f-2 comprising derived and/or modified sequence from HRSV(A2)__F-del_DSCav1_mut7 (opt6)
  source 1..1910: mol_type = other RNA
gggagagcggctcggccattttgtcccagtcagtccggaggctgcggctgcagaagtaccgcctgcggagtaactgcaaagaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7403 - RNA, 1910 nt, synthetic construct
  misc_feature 1..1910: note = mRNA product Design f-2 comprising derived and/or modified sequence from HRSV(A2)__F-del_DSCav1_mut7 (opt11)
  source 1..1910: mol_type = other RNA
gggagagcggctcggccattttgtcccagtcagtccggaggctgcggctgcagaagtaccgcctgcggagtaactgcaaagaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7404 - RNA, 1901 nt, synthetic construct
  misc_feature 1..1901: note = mRNA product Design f-3 comprising derived and/or modified sequence from HRSV(A2)__F-del_DSCav1_mut7 (opt1)
  source 1..1901: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7405 - RNA, 1901 nt, synthetic construct
  misc_feature 1..1901: note = mRNA product Design f-3 comprising derived and/or modified sequence from HRSV(A2)__F-del_DSCav1_mut7 (opt1)
  source 1..1901: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7406 - RNA, 1901 nt, synthetic construct
  misc_feature 1..1901: note = mRNA product Design f-3 comprising derived and/or modified sequence from HRSV(A2)__F-del_DSCav1_mut7 (opt2)
  source 1..1901: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7407 - RNA, 1901 nt, synthetic construct
  misc_feature 1..1901: note = mRNA product Design f-3 comprising derived and/or modified sequence from HRSV(A2)__F-del_DSCav1_mut7 (opt3)
  source 1..1901: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7408 - RNA, 1901 nt, synthetic construct
  misc_feature 1..1901: note = mRNA product Design f-3 comprising derived and/or modified sequence from HRSV(A2)__F-del_DSCav1_mut7 (opt4)
  source 1..1901: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7409 - RNA, 1901 nt, synthetic construct
  misc_feature 1..1901: note = mRNA product Design f-3 comprising derived and/or modified sequence from HRSV(A2)__F-del_DSCav1_mut7 (opt5)
  source 1..1901: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7410 - RNA, 1901 nt, synthetic construct
  misc_feature 1..1901: note = mRNA product Design f-3 comprising derived and/or modified sequence from HRSV(A2)__F-del_DSCav1_mut7 (opt6)
  source 1..1901: mol_type = other RNA
gggagagtcccgcagtcggcgtccagcggctctgcttgttcgtgtgtgtgtcgttgcaggccttattcaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7411 - RNA, 1901 nt, synthetic construct
  misc_feature 1..1901: note = mRNA product Design f-3 comprising derived and/or modified sequence from HRSV(A2)__F-del_DSCav1_mut7 (opt11)
  source 1..1901: mol_type = other RNA
gggagagtcccgcagtcggcgtccagcggctctgcttgttcgtgtgtgtgtcgttgcaggccttattcaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7412 - RNA, 2117 nt, synthetic construct
  misc_feature 1..2117: note = mRNA product Design f-4 comprising derived and/or modified sequence from HRSV(A2)__F-del_DSCav1_mut7 (opt1)
  source 1..2117: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7413 - RNA, 2117 nt, synthetic construct
  misc_feature 1..2117: note = mRNA product Design f-4 comprising derived and/or modified sequence from HRSV(A2)__F-del_DSCav1_mut7 (opt1)
  source 1..2117: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7414 - RNA, 2117 nt, synthetic construct
  misc_feature 1..2117: note = mRNA product Design f-4 comprising derived and/or modified sequence from HRSV(A2)__F-del_DSCav1_mut7 (opt2)
  source 1..2117: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7415 - RNA, 2117 nt, synthetic construct
  misc_feature 1..2117: note = mRNA product Design f-4 comprising derived and/or modified sequence from HRSV(A2)__F-del_DSCav1_mut7 (opt3)
  source 1..2117: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7416 - RNA, 2117 nt, synthetic construct
  misc_feature 1..2117: note = mRNA product Design f-4 comprising derived and/or modified sequence from HRSV(A2)__F-del_DSCav1_mut7 (opt4)
  source 1..2117: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7417 - RNA, 2117 nt, synthetic construct
  misc_feature 1..2117: note = mRNA product Design f-4 comprising derived and/or modified sequence from HRSV(A2)__F-del_DSCav1_mut7 (opt5)
  source 1..2117: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7418 - RNA, 2117 nt, synthetic construct
  misc_feature 1..2117: note = mRNA product Design f-4 comprising derived and/or modified sequence from HRSV(A2)__F-del_DSCav1_mut7 (opt6)
  source 1..2117: mol_type = other RNA
gggagagtcccgcagtcggcgtccagcggctctgcttgttcgtgtgtgtgtcgttgcaggccttattcaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7419 - RNA, 2117 nt, synthetic construct
  misc_feature 1..2117: note = mRNA product Design f-4 comprising derived and/or modified sequence from HRSV(A2)__F-del_DSCav1_mut7 (opt11)
  source 1..2117: mol_type = other RNA
gggagagtcccgcagtcggcgtccagcggctctgcttgttcgtgtgtgtgtcgttgcaggccttattcaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7420 - RNA, 1893 nt, synthetic construct
  misc_feature 1..1893: note = mRNA product Design f-5 comprising derived and/or modified sequence from HRSV(A2)__F-del_DSCav1_mut7 (opt1)
  source 1..1893: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7421 - RNA, 1893 nt, synthetic construct
  misc_feature 1..1893: note = mRNA product Design f-5 comprising derived and/or modified sequence from HRSV(A2)__F-del_DSCav1_mut7 (opt1)
  source 1..1893: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7422 - RNA, 1893 nt, synthetic construct
  misc_feature 1..1893: note = mRNA product Design f-5 comprising derived and/or modified sequence from HRSV(A2)__F-del_DSCav1_mut7 (opt2)
  source 1..1893: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7423 - RNA, 1893 nt, synthetic construct
  misc_feature 1..1893: note = mRNA product Design f-5 comprising derived and/or modified sequence from HRSV(A2)__F-del_DSCav1_mut7 (opt3)
  source 1..1893: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7424 - RNA, 1893 nt, synthetic construct
  misc_feature 1..1893: note = mRNA product Design f-5 comprising derived and/or modified sequence from HRSV(A2)__F-del_DSCav1_mut7 (opt4)
  source 1..1893: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7425 - RNA, 1893 nt, synthetic construct
  misc_feature 1..1893: note = mRNA product Design f-5 comprising derived and/or modified sequence from HRSV(A2)__F-del_DSCav1_mut7 (opt5)
  source 1..1893: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7426 - RNA, 1893 nt, synthetic construct
  misc_feature 1..1893: note = mRNA product Design f-5 comprising derived and/or modified sequence from HRSV(A2)__F-del_DSCav1_mut7 (opt6)
  source 1..1893: mol_type = other RNA
gggagactttcccattctgtagcagaatttggtgttgcctgtggtcttggtcccgcggagaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7427 - RNA, 1893 nt, synthetic construct
  misc_feature 1..1893: note = mRNA product Design f-5 comprising derived and/or modified sequence from HRSV(A2)__F-del_DSCav1_mut7 (opt11)
  source 1..1893: mol_type = other RNA
gggagactttcccattctgtagcagaatttggtgttgcctgtggtcttggtcccgcggagaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7428 - RNA, 1889 nt, synthetic construct
  misc_feature 1..1889: note = mRNA product Design g-1 comprising derived and/or modified sequence from HRSV(A2)__F-del_DSCav1_mut7 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7429 - RNA, 1889 nt, synthetic construct
  misc_feature 1..1889: note = mRNA product Design g-1 comprising derived and/or modified sequence from HRSV(A2)__F-del_DSCav1_mut7 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7430 - RNA, 1889 nt, synthetic construct
  misc_feature 1..1889: note = mRNA product Design g-1 comprising derived and/or modified sequence from HRSV(A2)__F-del_DSCav1_mut7 (opt2)
  source 1..1889: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7431 - RNA, 1889 nt, synthetic construct
  misc_feature 1..1889: note = mRNA product Design g-1 comprising derived and/or modified sequence from HRSV(A2)__F-del_DSCav1_mut7 (opt3)
  source 1..1889: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7432 - RNA, 1889 nt, synthetic construct
  misc_feature 1..1889: note = mRNA product Design g-1 comprising derived and/or modified sequence from HRSV(A2)__F-del_DSCav1_mut7 (opt4)
  source 1..1889: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7433 - RNA, 1889 nt, synthetic construct
  misc_feature 1..1889: note = mRNA product Design g-1 comprising derived and/or modified sequence from HRSV(A2)__F-del_DSCav1_mut7 (opt5)
  source 1..1889: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7434 - RNA, 1889 nt, synthetic construct
  misc_feature 1..1889: note = mRNA product Design g-1 comprising derived and/or modified sequence from HRSV(A2)__F-del_DSCav1_mut7 (opt6)
  source 1..1889: mol_type = other RNA
gggagactttcccattctgtagcagaatttggtgttgcctgtggtcttggtcccgcggagaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7435 - RNA, 1889 nt, synthetic construct
  misc_feature 1..1889: note = mRNA product Design g-1 comprising derived and/or modified sequence from HRSV(A2)__F-del_DSCav1_mut7 (opt11)
  source 1..1889: mol_type = other RNA
gggagactttcccattctgtagcagaatttggtgttgcctgtggtcttggtcccgcggagaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7436 - RNA, 1904 nt, synthetic construct
  misc_feature 1..1904: note = mRNA product Design g-2 comprising derived and/or modified sequence from HRSV(A2)__F-del_DSCav1_mut7 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7437 - RNA, 1904 nt, synthetic construct
  misc_feature 1..1904: note = mRNA product Design g-2 comprising derived and/or modified sequence from HRSV(A2)__F-del_DSCav1_mut7 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7438 - RNA, 1904 nt, synthetic construct
  misc_feature 1..1904: note = mRNA product Design g-2 comprising derived and/or modified sequence from HRSV(A2)__F-del_DSCav1_mut7 (opt2)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7439 - RNA, 1904 nt, synthetic construct
  misc_feature 1..1904: note = mRNA product Design g-2 comprising derived and/or modified sequence from HRSV(A2)__F-del_DSCav1_mut7 (opt3)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7440 - RNA, 1904 nt, synthetic construct
  misc_feature 1..1904: note = mRNA product Design g-2 comprising derived and/or modified sequence from HRSV(A2)__F-del_DSCav1_mut7 (opt4)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7441 - RNA, 1904 nt, synthetic construct
  misc_feature 1..1904: note = mRNA product Design g-2 comprising derived and/or modified sequence from HRSV(A2)__F-del_DSCav1_mut7 (opt5)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7442 - RNA, 1904 nt, synthetic construct
  misc_feature 1..1904: note = mRNA product Design g-2 comprising derived and/or modified sequence from HRSV(A2)__F-del_DSCav1_mut7 (opt6)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7443 - RNA, 1904 nt, synthetic construct
  misc_feature 1..1904: note = mRNA product Design g-2 comprising derived and/or modified sequence from HRSV(A2)__F-del_DSCav1_mut7 (opt11)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7444 - RNA, 2136 nt, synthetic construct
  misc_feature 1..2136: note = mRNA product Design g-3 comprising derived and/or modified sequence from HRSV(A2)__F-del_DSCav1_mut7 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7445 - RNA, 2136 nt, synthetic construct
  misc_feature 1..2136: note = mRNA product Design g-3 comprising derived and/or modified sequence from HRSV(A2)__F-del_DSCav1_mut7 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7446 - RNA, 2136 nt, synthetic construct
  misc_feature 1..2136: note = mRNA product Design g-3 comprising derived and/or modified sequence from HRSV(A2)__F-del_DSCav1_mut7 (opt2)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7447 - RNA, 2136 nt, synthetic construct
  misc_feature 1..2136: note = mRNA product Design g-3 comprising derived and/or modified sequence from HRSV(A2)__F-del_DSCav1_mut7 (opt3)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7448 - RNA, 2136 nt, synthetic construct
  misc_feature 1..2136: note = mRNA product Design g-3 comprising derived and/or modified sequence from HRSV(A2)__F-del_DSCav1_mut7 (opt4)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7449 - RNA, 2136 nt, synthetic construct
  misc_feature 1..2136: note = mRNA product Design g-3 comprising derived and/or modified sequence from HRSV(A2)__F-del_DSCav1_mut7 (opt5)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7450 - RNA, 2136 nt, synthetic construct
  misc_feature 1..2136: note = mRNA product Design g-3 comprising derived and/or modified sequence from HRSV(A2)__F-del_DSCav1_mut7 (opt6)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7451 - RNA, 2136 nt, synthetic construct
  misc_feature 1..2136: note = mRNA product Design g-3 comprising derived and/or modified sequence from HRSV(A2)__F-del_DSCav1_mut7 (opt11)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7452 - RNA, 1931 nt, synthetic construct
  misc_feature 1..1931: note = mRNA product Design g-4 comprising derived and/or modified sequence from HRSV(A2)__F-del_DSCav1_mut7 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7453 - RNA, 1931 nt, synthetic construct
  misc_feature 1..1931: note = mRNA product Design g-4 comprising derived and/or modified sequence from HRSV(A2)__F-del_DSCav1_mut7 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7454 - RNA, 1931 nt, synthetic construct
  misc_feature 1..1931: note = mRNA product Design g-4 comprising derived and/or modified sequence from HRSV(A2)__F-del_DSCav1_mut7 (opt2)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7455 - RNA, 1931 nt, synthetic construct
  misc_feature 1..1931: note = mRNA product Design g-4 comprising derived and/or modified sequence from HRSV(A2)__F-del_DSCav1_mut7 (opt3)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7456 - RNA, 1931 nt, synthetic construct
  misc_feature 1..1931: note = mRNA product Design g-4 comprising derived and/or modified sequence from HRSV(A2)__F-del_DSCav1_mut7 (opt4)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7457 - RNA, 1931 nt, synthetic construct
  misc_feature 1..1931: note = mRNA product Design g-4 comprising derived and/or modified sequence from HRSV(A2)__F-del_DSCav1_mut7 (opt5)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7458 - RNA, 1931 nt, synthetic construct
  misc_feature 1..1931: note = mRNA product Design g-4 comprising derived and/or modified sequence from HRSV(A2)__F-del_DSCav1_mut7 (opt6)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7459 - RNA, 1931 nt, synthetic construct
  misc_feature 1..1931: note = mRNA product Design g-4 comprising derived and/or modified sequence from HRSV(A2)__F-del_DSCav1_mut7 (opt11)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7460 - RNA, 1907 nt, synthetic construct
  misc_feature 1..1907: note = mRNA product Design g-5 comprising derived and/or modified sequence from HRSV(A2)__F-del_DSCav1_mut7 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7461 - RNA, 1907 nt, synthetic construct
  misc_feature 1..1907: note = mRNA product Design g-5 comprising derived and/or modified sequence from HRSV(A2)__F-del_DSCav1_mut7 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7462 - RNA, 1907 nt, synthetic construct
  misc_feature 1..1907: note = mRNA product Design g-5 comprising derived and/or modified sequence from HRSV(A2)__F-del_DSCav1_mut7 (opt2)
  source 1..1907: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7463 - RNA, 1907 nt, synthetic construct
  misc_feature 1..1907: note = mRNA product Design g-5 comprising derived and/or modified sequence from HRSV(A2)__F-del_DSCav1_mut7 (opt3)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7464 - RNA, 1907 nt, synthetic construct
  misc_feature 1..1907: note = mRNA product Design g-5 comprising derived and/or modified sequence from HRSV(A2)__F-del_DSCav1_mut7 (opt4)
  source 1..1907: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7465 - RNA, 1907 nt, synthetic construct
  misc_feature 1..1907: note = mRNA product Design g-5 comprising derived and/or modified sequence from HRSV(A2)__F-del_DSCav1_mut7 (opt5)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7466 - RNA, 1907 nt, synthetic construct
  misc_feature 1..1907: note = mRNA product Design g-5 comprising derived and/or modified sequence from HRSV(A2)__F-del_DSCav1_mut7 (opt6)
  source 1..1907: mol_type = other RNA
gggagacccgtgacccggaagttgtacggctacgcgactttccctcccacaaaccctcgcgcccttcctttcctacttgggcccggcagaaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7467 - RNA, 1907 nt, synthetic construct
  misc_feature 1..1907: note = mRNA product Design g-5 comprising derived and/or modified sequence from HRSV(A2)__F-del_DSCav1_mut7 (opt11)
  source 1..1907: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7468 - RNA, 1923 nt, synthetic construct
  misc_feature 1..1923: note = mRNA product Design h-1 comprising derived and/or modified sequence from HRSV(A2)__F-del_DSCav1_mut7 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7469 - RNA, 1923 nt, synthetic construct
  misc_feature 1..1923: note = mRNA product Design h-1 comprising derived and/or modified sequence from HRSV(A2)__F-del_DSCav1_mut7 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7470 - RNA, 1923 nt, synthetic construct
  misc_feature 1..1923: note = mRNA product Design h-1 comprising derived and/or modified sequence from HRSV(A2)__F-del_DSCav1_mut7 (opt2)
  source 1..1923: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7471 - RNA, 1923 nt, synthetic construct
  misc_feature 1..1923: note = mRNA product Design h-1 comprising derived and/or modified sequence from HRSV(A2)__F-del_DSCav1_mut7 (opt3)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7472 - RNA, 1923 nt, synthetic construct
  misc_feature 1..1923: note = mRNA product Design h-1 comprising derived and/or modified sequence from HRSV(A2)__F-del_DSCav1_mut7 (opt4)
  source 1..1923: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7473 - RNA, 1923 nt, synthetic construct
  misc_feature 1..1923: note = mRNA product Design h-1 comprising derived and/or modified sequence from HRSV(A2)__F-del_DSCav1_mut7 (opt5)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7474 - RNA, 1923 nt, synthetic construct
  misc_feature 1..1923: note = mRNA product Design h-1 comprising derived and/or modified sequence from HRSV(A2)__F-del_DSCav1_mut7 (opt6)
  source 1..1923: mol_type = other RNA
gggagacccgtgacccggaagttgtacggctacgcgactttccctcccacaaaccctcgcgcccttcctttcctacttgggcccggcagaaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7475 - RNA, 1923 nt, synthetic construct
  misc_feature 1..1923: note = mRNA product Design h-1 comprising derived and/or modified sequence from HRSV(A2)__F-del_DSCav1_mut7 (opt11)
  source 1..1923: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7476 - RNA, 2139 nt, synthetic construct
  misc_feature 1..2139: note = mRNA product Design h-2 comprising derived and/or modified sequence from HRSV(A2)__F-del_DSCav1_mut7 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7477 - RNA, 2139 nt, synthetic construct
  misc_feature 1..2139: note = mRNA product Design h-2 comprising derived and/or modified sequence from HRSV(A2)__F-del_DSCav1_mut7 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7478 - RNA, 2139 nt, synthetic construct
  misc_feature 1..2139: note = mRNA product Design h-2 comprising derived and/or modified sequence from HRSV(A2)__F-del_DSCav1_mut7 (opt2)
  source 1..2139: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7479 - RNA, 2139 nt, synthetic construct
  misc_feature 1..2139: note = mRNA product Design h-2 comprising derived and/or modified sequence from HRSV(A2)__F-del_DSCav1_mut7 (opt3)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7480 - RNA, 2139 nt, synthetic construct
  misc_feature 1..2139: note = mRNA product Design h-2 comprising derived and/or modified sequence from HRSV(A2)__F-del_DSCav1_mut7 (opt4)
  source 1..2139: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7481 - RNA, 2139 nt, synthetic construct
  misc_feature 1..2139: note = mRNA product Design h-2 comprising derived and/or modified sequence from HRSV(A2)__F-del_DSCav1_mut7 (opt5)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7482 - RNA, 2139 nt, synthetic construct
  misc_feature 1..2139: note = mRNA product Design h-2 comprising derived and/or modified sequence from HRSV(A2)__F-del_DSCav1_mut7 (opt6)
  source 1..2139: mol_type = other RNA
gggagacccgtgacccggaagttgtacggctacgcgactttccctcccacaaaccctcgcgcccttcctttcctacttgggcccggcagaaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7483 - RNA, 2139 nt, synthetic construct
  misc_feature 1..2139: note = mRNA product Design h-2 comprising derived and/or modified sequence from HRSV(A2)__F-del_DSCav1_mut7 (opt11)
  source 1..2139: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7484 - RNA, 1919 nt, synthetic construct
  misc_feature 1..1919: note = mRNA product Design h-3 comprising derived and/or modified sequence from HRSV(A2)__F-del_DSCav1_mut7 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7485 - RNA, 1919 nt, synthetic construct
  misc_feature 1..1919: note = mRNA product Design h-3 comprising derived and/or modified sequence from HRSV(A2)__F-del_DSCav1_mut7 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7486 - RNA, 1919 nt, synthetic construct
  misc_feature 1..1919: note = mRNA product Design h-3 comprising derived and/or modified sequence from HRSV(A2)__F-del_DSCav1_mut7 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7487 - RNA, 1919 nt, synthetic construct
  misc_feature 1..1919: note = mRNA product Design h-3 comprising derived and/or modified sequence from HRSV(A2)__F-del_DSCav1_mut7 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7488 - RNA, 1919 nt, synthetic construct
  misc_feature 1..1919: note = mRNA product Design h-3 comprising derived and/or modified sequence from HRSV(A2)__F-del_DSCav1_mut7 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7489 - RNA, 1919 nt, synthetic construct
  misc_feature 1..1919: note = mRNA product Design h-3 comprising derived and/or modified sequence from HRSV(A2)__F-del_DSCav1_mut7 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7490 - RNA, 1919 nt, synthetic construct
  misc_feature 1..1919: note = mRNA product Design h-3 comprising derived and/or modified sequence from HRSV(A2)__F-del_DSCav1_mut7 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7491 - RNA, 1919 nt, synthetic construct
  misc_feature 1..1919: note = mRNA product Design h-3 comprising derived and/or modified sequence from HRSV(A2)__F-del_DSCav1_mut7 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7492 - RNA, 1982 nt, synthetic construct
  misc_feature 1..1982: note = mRNA product Design h-4 comprising derived and/or modified sequence from HRSV(A2)__F-del_DSCav1_mut7 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7493 - RNA, 1982 nt, synthetic construct
  misc_feature 1..1982: note = mRNA product Design h-4 comprising derived and/or modified sequence from HRSV(A2)__F-del_DSCav1_mut7 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7494 - RNA, 1982 nt, synthetic construct
  misc_feature 1..1982: note = mRNA product Design h-4 comprising derived and/or modified sequence from HRSV(A2)__F-del_DSCav1_mut7 (opt2)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7495 - RNA, 1982 nt, synthetic construct
  misc_feature 1..1982: note = mRNA product Design h-4 comprising derived and/or modified sequence from HRSV(A2)__F-del_DSCav1_mut7 (opt3)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7496 - RNA, 1982 nt, synthetic construct
  misc_feature 1..1982: note = mRNA product Design h-4 comprising derived and/or modified sequence from HRSV(A2)__F-del_DSCav1_mut7 (opt4)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7497 - RNA, 1982 nt, synthetic construct
  misc_feature 1..1982: note = mRNA product Design h-4 comprising derived and/or modified sequence from HRSV(A2)__F-del_DSCav1_mut7 (opt5)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7498 - RNA, 1982 nt, synthetic construct
  misc_feature 1..1982: note = mRNA product Design h-4 comprising derived and/or modified sequence from HRSV(A2)__F-del_DSCav1_mut7 (opt6)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7499 - RNA, 1982 nt, synthetic construct
  misc_feature 1..1982: note = mRNA product Design h-4 comprising derived and/or modified sequence from HRSV(A2)__F-del_DSCav1_mut7 (opt11)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7500 - RNA, 1998 nt, synthetic construct
  misc_feature 1..1998: note = mRNA product Design h-5 comprising derived and/or modified sequence from HRSV(A2)__F-del_DSCav1_mut7 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7501 - RNA, 1998 nt, synthetic construct
  misc_feature 1..1998: note = mRNA product Design h-5 comprising derived and/or modified sequence from HRSV(A2)__F-del_DSCav1_mut7 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7502 - RNA, 1998 nt, synthetic construct
  misc_feature 1..1998: note = mRNA product Design h-5 comprising derived and/or modified sequence from HRSV(A2)__F-del_DSCav1_mut7 (opt2)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7503 - RNA, 1998 nt, synthetic construct
  misc_feature 1..1998: note = mRNA product Design h-5 comprising derived and/or modified sequence from HRSV(A2)__F-del_DSCav1_mut7 (opt3)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7504 - RNA, 1998 nt, synthetic construct
  misc_feature 1..1998: note = mRNA product Design h-5 comprising derived and/or modified sequence from HRSV(A2)__F-del_DSCav1_mut7 (opt4)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7505 - RNA, 1998 nt, synthetic construct
  misc_feature 1..1998: note = mRNA product Design h-5 comprising derived and/or modified sequence from HRSV(A2)__F-del_DSCav1_mut7 (opt5)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7506 - RNA, 1998 nt, synthetic construct
  misc_feature 1..1998: note = mRNA product Design h-5 comprising derived and/or modified sequence from HRSV(A2)__F-del_DSCav1_mut7 (opt6)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7507 - RNA, 1998 nt, synthetic construct
  misc_feature 1..1998: note = mRNA product Design h-5 comprising derived and/or modified sequence from HRSV(A2)__F-del_DSCav1_mut7 (opt11)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7508 - RNA, 1931 nt, synthetic construct
  misc_feature 1..1931: note = mRNA product Design i-1 comprising derived and/or modified sequence from HRSV(A2)__F-del_DSCav1_mut7 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7509 - RNA, 1931 nt, synthetic construct
  misc_feature 1..1931: note = mRNA product Design i-1 comprising derived and/or modified sequence from HRSV(A2)__F-del_DSCav1_mut7 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7510 - RNA, 1931 nt, synthetic construct
  misc_feature 1..1931: note = mRNA product Design i-1 comprising derived and/or modified sequence from HRSV(A2)__F-del_DSCav1_mut7 (opt2)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7511 - RNA, 1931 nt, synthetic construct
  misc_feature 1..1931: note = mRNA product Design i-1 comprising derived and/or modified sequence from HRSV(A2)__F-del_DSCav1_mut7 (opt3)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7512 - RNA, 1931 nt, synthetic construct
  misc_feature 1..1931: note = mRNA product Design i-1 comprising derived and/or modified sequence from HRSV(A2)__F-del_DSCav1_mut7 (opt4)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7513 - RNA, 1931 nt, synthetic construct
  misc_feature 1..1931: note = mRNA product Design i-1 comprising derived and/or modified sequence from HRSV(A2)__F-del_DSCav1_mut7 (opt5)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7514 - RNA, 1931 nt, synthetic construct
  misc_feature 1..1931: note = mRNA product Design i-1 comprising derived and/or modified sequence from HRSV(A2)__F-del_DSCav1_mut7 (opt6)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7515 - RNA, 1931 nt, synthetic construct
  misc_feature 1..1931: note = mRNA product Design i-1 comprising derived and/or modified sequence from HRSV(A2)__F-del_DSCav1_mut7 (opt11)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7516 - RNA, 1931 nt, synthetic construct
  misc_feature 1..1931: note = mRNA product Design i-2 comprising derived and/or modified sequence from HRSV(A2)__F-del_DSCav1_mut7 (opt1)
  source 1..1931: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7517 - RNA, 1931 nt, synthetic construct
  misc_feature 1..1931: note = mRNA product Design i-2 comprising derived and/or modified sequence from HRSV(A2)__F-del_DSCav1_mut7 (opt1)
  source 1..1931: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7518 - RNA, 1931 nt, synthetic construct
  misc_feature 1..1931: note = mRNA product Design i-2 comprising derived and/or modified sequence from HRSV(A2)__F-del_DSCav1_mut7 (opt2)
  source 1..1931: mol_type = other RNA
gggagaggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7519 - RNA, 1931 nt, synthetic construct
  misc_feature 1..1931: note = mRNA product Design i-2 comprising derived and/or modified sequence from HRSV(A2)__F-del_DSCav1_mut7 (opt3)
  source 1..1931: mol_type = other RNA
gggagaggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7520 - RNA, 1931 nt, synthetic construct
  misc_feature 1..1931: note = mRNA product Design i-2 comprising derived and/or modified sequence from HRSV(A2)__F-del_DSCav1_mut7 (opt4)
  source 1..1931: mol_type = other RNA
gggagaggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7521 - RNA, 1931 nt, synthetic construct
  misc_feature 1..1931: note = mRNA product Design i-2 comprising derived and/or modified sequence from HRSV(A2)__F-del_DSCav1_mut7 (opt5)
  source 1..1931: mol_type = other RNA
gggagaggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7522 - RNA, 1931 nt, synthetic construct
  misc_feature 1..1931: note = mRNA product Design i-2 comprising derived and/or modified sequence from HRSV(A2)__F-del_DSCav1_mut7 (opt6)
  source 1..1931: mol_type = other RNA
gggagaggcgctgcctacggaggtggcagccatctccttctcggcatcaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7523 - RNA, 1931 nt, synthetic construct
  misc_feature 1..1931: note = mRNA product Design i-2 comprising derived and/or modified sequence from HRSV(A2)__F-del_DSCav1_mut7 (opt11)
  source 1..1931: mol_type = other RNA
gggagaggcgctgcctacggaggtggcagccatctccttctcggcatcaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7524 - RNA, 1927 nt, synthetic construct
  misc_feature 1..1927: note = mRNA product Design i-2 comprising derived and/or modified sequence from HRSV(A2)__F-del_DSCav1_mut7 (opt1)
  source 1..1927: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7525 - RNA, 1927 nt, synthetic construct
  misc_feature 1..1927: note = mRNA product Design i-2 comprising derived and/or modified sequence from HRSV(A2)__F-del_DSCav1_mut7 (opt1)
  source 1..1927: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7526 - RNA, 1927 nt, synthetic construct
  misc_feature 1..1927: note = mRNA product Design i-2 comprising derived and/or modified sequence from HRSV(A2)__F-del_DSCav1_mut7 (opt2)
  source 1..1927: mol_type = other RNA
ggggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7527 - RNA, 1927 nt, synthetic construct
  misc_feature 1..1927: note = mRNA product Design i-2 comprising derived and/or modified sequence from HRSV(A2)__F-del_DSCav1_mut7 (opt3)
  source 1..1927: mol_type = other RNA
ggggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7528 - RNA, 1927 nt, synthetic construct
  misc_feature 1..1927: note = mRNA product Design i-2 comprising derived and/or modified sequence from HRSV(A2)__F-del_DSCav1_mut7 (opt4)
  source 1..1927: mol_type = other RNA
ggggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7529 - RNA, 1927 nt, synthetic construct
  misc_feature 1..1927: note = mRNA product Design i-2 comprising derived and/or modified sequence from HRSV(A2)__F-del_DSCav1_mut7 (opt5)
  source 1..1927: mol_type = other RNA
ggggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7530 - RNA, 1927 nt, synthetic construct
  misc_feature 1..1927: note = mRNA product Design i-2 comprising derived and/or modified sequence from HRSV(A2)__F-del_DSCav1_mut7 (opt6)
  source 1..1927: mol_type = other RNA
ggggcgctgcctacggaggtggcagccatctccttctcggcatcaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7531 - RNA, 1927 nt, synthetic construct
  misc_feature 1..1927: note = mRNA product Design i-2 comprising derived and/or modified sequence from HRSV(A2)__F-del_DSCav1_mut7 (opt11)
  source 1..1927: mol_type = other RNA
ggggcgctgcctacggaggtggcagccatctccttctcggcatcaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7532 - RNA, 1762 nt, synthetic construct
  misc_feature 1..1762: note = mRNA product Design i-3 comprising derived and/or modified sequence from HRSV(A2)__F-del_DSCav1_mut7 (opt1)
  source 1..1762: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7533 - RNA, 1762 nt, synthetic construct
  misc_feature 1..1762: note = mRNA product Design i-3 comprising derived and/or modified sequence from HRSV(A2)__F-del_DSCav1_mut7 (opt1)
  source 1..1762: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagatgctcatgtgctccacccccgccaccggcagcgggtccgccatcgccagcggcgtggcggtgtgcaaggtcctgcacctggagggcgaggtgaacaagatcaagtccgccctcctgagcaccaacaaggccgtggtctccctgagcaacggggtgtccgtgctcacgttcaaggtcctggacctgaagaactacatcgacaagcagctcctgccgatcctgaacaagcagagctgctccatcagcaacatcgagaccgtgatggagttccagcagaagaacaaccggctcctggagatcacccgcgagttctccgtgaacgccggcgtcaccacgcccgtgagcacctacatgctgaccaacagcgagctcctgtccctgatcaacgacatgcccatcaccaacgaccagaagaagctcatgagcaacaacgtgcagatcgtccggcagcagtcctacagcatcatgtgcatcatcaaggaggaggtgctggcctacgtggtccagctgcccctctacggggtgatcgacacgccgtgctggaagctgcacaccagccccctgtgcaccaccaacacgaaggagggcagcaacatctgcctcacccgcaccgaccgggggtggtactgcgacaacgcgggctccgtgagcttcttcccccaggccgagacctgcaaggtctgctccaaccgcgtgttctgcgacacgatgaacagcctgaccctgccctccgaggtcaacctctgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaacaagggcatcatcaagaccttctccaacgggtgcgactacgtgagcaacaagggcgtcgacacggtgagcgtgggcaacaccctgtactacgtcaacaagcaggaggggaagtccctctacgtgaagggcgagcccatcatcaacttctacgaccccctggtgttccccagcgacgagttcgacgcctccatcagccaggtcaacgagaagatcaaccagtccctggcgttcatccggaagtccgacgagctcctgcacaacgtgaacgccgggaagtccaccaccaacatcatgatcaccacgatcatcatcgtgatcatcgtcatcctgctcagcctgatcgccgtgggcctgctcctgtactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7534 - RNA, 1762 nt, synthetic construct
  misc_feature 1..1762: note = mRNA product Design i-3 comprising derived and/or modified sequence from HRSV(A2)__F-del_DSCav1_mut7 (opt2)
  source 1..1762: mol_type = other RNA
gggagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7535 - RNA, 1762 nt, synthetic construct
  misc_feature 1..1762: note = mRNA product Design i-3 comprising derived and/or modified sequence from HRSV(A2)__F-del_DSCav1_mut7 (opt3)
  source 1..1762: mol_type = other RNA
gggagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagatgcttatgtgttctacacccgccaccggctcggggtcagctatagcaagcggagtggccgtctgcaaggtgctgcacttggagggcgaagttaacaaaatcaagagtgctctcctgtccacgaataaagccgtggtctctctgagcaacggtgtgtccgtactcacttttaaggttttagacctgaagaattacattgataaacagcttttgcctatcctgaacaagcaatcatgtagtattagcaatatcgagaccgtgatggagttccagcagaaaaacaataggctactcgaaataacacgggagttttctgtcaacgcgggggtgactaccccagtgtccacatatatgctgaccaattcagaacttctgagcttgattaacgacatgccgatcacgaacgatcagaagaaactcatgagtaataacgtccaaattgttcgccagcagtcttactccatcatgtgcatcattaaggaggaagtgctggcatatgtagtgcagttacccctgtacggagtcatagacactccttgttggaaactccatacaagcccactttgcaccactaatacaaaggagggctcgaacatctgtctgacccgaacggatcgtggctggtactgcgacaatgccgggtctgtgtccttctttccccaagctgaaacctgtaaggtttgctcaaacagagtgttctgcgatacaatgaatagtttgactctacctagcgaggtcaacctgtgtaatgtggacatttttaacccaaaatatgattgcaagatcatgacctccaaaacagacgtatctagctcagttataactagcctcggagccattgtgtcctgttacggtaagaccaaatgcacagcaagcaataagaacaagggcatcatcaaaaccttctctaatgggtgtgattatgtctcaaacaagggagtggacactgtcagtgtgggcaatacgctgtactatgttaacaaacaggagggtaagagcctttacgtgaaaggggaacccattatcaacttttatgaccctctggtattcccatccgatgagtttgacgcttctatttcgcaggtcaatgaaaagataaaccaaagtttggccttcatcaggaagtccgatgagctcctgcacaatgtgaacgcgggaaaatcaacaaccaatattatgatcactaccatcattatagttatcattgtgatcttactgagtctaattgccgtcggcctcctgctttactgcaaggcacggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7536 - RNA, 1762 nt, synthetic construct
  misc_feature 1..1762: note = mRNA product Design i-3 comprising derived and/or modified sequence from HRSV(A2)__F-del_DSCav1_mut7 (opt4)
  source 1..1762: mol_type = other RNA
gggagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7537 - RNA, 1762 nt, synthetic construct
  misc_feature 1..1762: note = mRNA product Design i-3 comprising derived and/or modified sequence from HRSV(A2)__F-del_DSCav1_mut7 (opt5)
  source 1..1762: mol_type = other RNA
gggagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagatgctgatgtgttccacccccgccacagggtctggaagcgctattgcctccggcgtcgcggtgtgcaaggttctgcacctcgagggggaagtgaacaaaatcaagagcgccctgctttctaccaataaagctgtcgtgtccctgagcaacggagtttctgtgctcacatttaaggtcctggaccttaagaattacattgataaacagctgctccctatcctgaacaagcaatcctgtagcatttctaatatcgagaccgtgatggagttccagcagaaaaacaatcggctgctcgaaattacgcgcgagttttccgtgaacgccggcgtcacaaccccggttagcacatatatgctgaccaattccgaacttctgtctctcatcaacgacatgcccatcaccaacgatcagaagaaactgatgagcaataacgtgcaaattgtgagacagcagtcctacagcatcatgtgcattatcaaggaggaagtccttgcttatgtggttcagctgcctctctacggcgtgattgacacaccctgttggaaactgcatacgtctcctctgtgcaccacaaataccaaggaggggtccaacatctgtctcacacggaccgatcgcggatggtactgcgacaatgccggcagcgtctctttctttccccaagcggaaacgtgtaaggtgtgcagcaacagagttttctgcgatacaatgaactccctgacccttccttctgaggtgaatctgtgtaatgtcgacatctttaacccgaaatatgattgcaagattatgaccagcaaaacagacgtgtccagctctgtcatcacctccctcggggccattgtgagctgttacggaaagacaaaatgcacggcttctaataagaacaagggcatcattaaaaccttctccaatgggtgtgattatgttagcaacaagggagtggacacagtctccgtgggcaataccctgtactatgttaacaaacaggagggcaagtctctttacgtgaaaggggaacccatcatcaacttttatgaccctctggtcttccccagcgatgagtttgacgcctccatttctcaggtgaatgaaaagatcaaccaaagcctcgctttcattcggaagtccgatgagctgctgcacaatgtgaacgccggaaaaagcacaaccaatatcatgattacgaccatcattatcgttatcattgtcatcctcctgtctcttattgccgtgggcctgctcctgtactgcaaggctcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7538 - RNA, 1762 nt, synthetic construct
  misc_feature 1..1762: note = mRNA product Design i-3 comprising derived and/or modified sequence from HRSV(A2)__F-del_DSCav1_mut7 (opt6)
  source 1..1762: mol_type = other RNA
gggagaaagcttaccatggaattactaatcctcaaagcaaacgcaattacaaccatactaaccgctgtcaccttttgttttgcctcaggacaaaacataactgaagaattttaccaatcaacatgctccgcagtatctaaaggatacctcagcgcgttaagaacaggatggtacacatcggtaataaccatcgaattatccaacataaaagaaaataaatgcaatggaacagacgcaaaagtcaaattaattaaacaagaactagacaaatataaaaacgcagtaaccgaattacaaatgctaatgtgttcaacaccagcaacaggatcaggatcagctatagcttcaggagttgccgtatgcaaagtgctacacttagaaggagaagtgaataaaataaaatcagctctattatcaacgaacaaagccgtagtatctctatcaaatggcgtatcagtactcacattcaaagtactcgacctaaaaaactatatagataaacaactattacccatcctaaataaacaaagctgctctatatcaaacatcgaaacagtaatggaatttcaacaaaaaaacaacagactactagaaataacccgagagttctcagttaatgcaggagtaacaacaccagtctcaacatacatgctcacaaactcagaactcctatcactaataaatgacatgccaataacaaacgaccaaaaaaaactcatgtctaacaacgtccaaatagtaagacaacaatcctacagcataatgtgtataataaaagaagaagttttagcatacgtcgtacaactacccttatatggcgtaatagatacaccatgctggaaactccatacctcacctctatgtacaacaaataccaaagaaggttctaatatatgcctaacacgaactgaccgaggatggtactgtgacaacgcaggatcagtctctttctttccacaagcagaaacctgcaaagtatgcagtaaccgcgtattttgcgacacaatgaactccctaaccttaccatcagaagtaaacttatgtaacgtagacatattcaatccaaaatatgactgcaaaataatgacatcaaaaacagacgtaagctcatcagtaataacttcactaggcgcaattgtatcatgctatggaaaaaccaaatgtaccgcatccaacaaaaataaaggaataataaaaaccttctctaacggatgcgactacgtatcaaacaaaggtgtagatacagtttctgtaggaaacacactctactatgtaaataaacaagaaggaaaatcactatacgtaaaaggagaaccaataataaacttctatgacccacttgtatttccatctgatgaatttgatgcaagcatatcacaagtaaacgaaaaaataaaccaatctctagcctttatacgaaaaagcgacgaattactacataacgtcaacgctggaaaatcaacaacaaacataatgataacaacaataataatagtaataatagtcatcctattatcactaatcgccgtaggactactcctatactgcaaagctagataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7539 - RNA, 1762 nt, synthetic construct
  misc_feature 1..1762: note = mRNA product Design i-3 comprising derived and/or modified sequence from HRSV(A2)__F-del_DSCav1_mut7 (opt11)
  source 1..1762: mol_type = other RNA
gggagaaagcttaccatggaactcctcatcctcaaagccaacgccataaccactatcctcacagcagtcactttctgcttcgcctcaggacaaaacataaccgaagagttctaccaatccacatgctccgccgtctccaaaggctacctctcagcgctccgcaccggctggtacacatccgtcatcaccatcgaactaagcaacataaaagaaaacaaatgcaacggcaccgacgccaaagttaaactcatcaagcaagaactcgacaaatacaaaaacgcagtcacagaacttcaaatgctcatgtgctccacacccgccacaggttctggctcagcaatcgcaagcggcgtcgccgtatgcaaagtccttcacctcgaaggcgaagtcaacaaaatcaaatccgccctcctctccaccaataaagctgtcgtctcactctccaacggcgtcagcgtcctcacattcaaagtcctcgacctcaaaaactacatagacaagcaactcctcccgatactcaacaaacaaagctgctctatctccaacatcgaaaccgtcatggagttccaacagaaaaacaatcgtctcctcgaaatcacccgcgagttctcagtaaacgccggggtcaccacaccagtctccacctacatgctcaccaactccgaactccttagcctcataaacgacatgcccataaccaacgaccaaaagaaactcatgagcaacaacgtacaaatagtccgacaacaatcctattccatcatgtgtatcatcaaagaagaagtcctcgcatacgtagtccaactccccctatacggcgtaatcgacaccccatgttggaaactccacacctcaccactctgtaccaccaacaccaaagaaggctcaaacatctgcctcacccgcacagaccgcggctggtactgcgacaacgcgggctccgtcagcttctttccccaagcggaaacctgcaaagtctgcagcaacagagtcttctgcgacactatgaactccctcaccctcccctcagaagtcaacctctgcaacgtcgacatcttcaacccgaaatacgactgcaaaatcatgaccagcaaaactgacgtctcctcgtccgtcatcacctcactcggcgcaatcgtgagctgctacggcaaaaccaaatgcaccgcctccaacaaaaacaaaggcatcataaaaacattcagcaacggctgcgactacgtctcgaacaaaggagtcgacaccgtatcagtgggcaacaccctatactacgtaaacaagcaagaaggcaaatcactctacgtaaaaggcgaacccatcatcaacttctacgaccccctcgtcttcccctccgacgagttcgacgcctccatctctcaagtcaacgagaaaatcaaccaatcccttgccttcatacgtaaaagcgacgaactccttcacaacgtaaacgccgggaaatccaccactaacataatgatcaccaccatcatcatcgttatcatagtcatcctcctctctctcatagcagtcggcctactcctgtactgcaaagcgcgctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7540 - protein, 536 aa, synthetic construct
  REGION 1..536: note = derived and/or modified protein sequence (artificial) from HRSV(A2)__F_DSCav1_mut8
MELLILKANAITTILTAVTFCFASGQNITEEFYQSTCSAVSKGYLGALRTGWYTSVITIELSNIKEIKCNGTDAKVKLIKQELDKYKNAVTDLQLLMQSTPATGSGSAIASGVAVCKVLHLEGEVNKIKSALLSTNKAVVSLSGCGVSVLTFKVLDLKNYIDKQLLPILNKQSCSIPNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKCRGIIKTFSNGCDYVSNKGVDTVSVGNTLYYVNKQEGQSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 7541 - RNA, 1611 nt, synthetic construct
  misc_feature 1..1611: note = derived and/or modified CDS sequence (opt1) from HRSV(A2)__F_DSCav1_mut8
  source 1..1611: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactga

SEQ ID NO: 7542 - RNA, 1611 nt, synthetic construct
  misc_feature 1..1611: note = derived and/or modified CDS sequence (opt1) from HRSV(A2)__F_DSCav1_mut8
  source 1..1611: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactga

SEQ ID NO: 7543 - RNA, 1611 nt, synthetic construct
  misc_feature 1..1611: note = derived and/or modified CDS sequence (opt2) from HRSV(A2)__F_DSCav1_mut8
  source 1..1611: mol_type = other RNA
atggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactga

SEQ ID NO: 7544 - RNA, 1611 nt, synthetic construct
  misc_feature 1..1611: note = derived and/or modified CDS sequence (opt3) from HRSV(A2)__F_DSCav1_mut8
  source 1..1611: mol_type = other RNA
atggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattga

SEQ ID NO: 7545 - RNA, 1611 nt, synthetic construct
  misc_feature 1..1611: note = derived and/or modified CDS sequence (opt4) from HRSV(A2)__F_DSCav1_mut8
  source 1..1611: mol_type = other RNA
atggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactga

SEQ ID NO: 7546 - RNA, 1611 nt, synthetic construct
  misc_feature 1..1611: note = derived and/or modified CDS sequence (opt5) from HRSV(A2)__F_DSCav1_mut8
  source 1..1611: mol_type = other RNA
atggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattga

SEQ ID NO: 7547 - RNA, 1611 nt, synthetic construct
  misc_feature 1..1611: note = derived and/or modified CDS sequence (opt6) from HRSV(A2)__F_DSCav1_mut8
  source 1..1611: mol_type = other RNA
atggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaa

SEQ ID NO: 7548 - RNA, 1611 nt, synthetic construct
  misc_feature 1..1611: note = derived and/or modified CDS sequence (opt11) from HRSV(A2)__F_DSCav1_mut8
  source 1..1611: mol_type = other RNA
atggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactga

SEQ ID NO: 7549 - RNA, 1887 nt, synthetic construct
  misc_feature 1..1887: note = mRNA product Design a-1 comprising derived and/or modified sequence from HRSV(A2)__F_DSCav1_mut8 (opt1)
  source 1..1887: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7550 - RNA, 1887 nt, synthetic construct
  misc_feature 1..1887: note = mRNA product Design a-1 comprising derived and/or modified sequence from HRSV(A2)__F_DSCav1_mut8 (opt1)
  source 1..1887: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7551 - RNA, 1887 nt, synthetic construct
  misc_feature 1..1887: note = mRNA product Design a-1 comprising derived and/or modified sequence from HRSV(A2)__F_DSCav1_mut8 (opt2)
  source 1..1887: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7552 - RNA, 1887 nt, synthetic construct
  misc_feature 1..1887: note = mRNA product Design a-1 comprising derived and/or modified sequence from HRSV(A2)__F_DSCav1_mut8 (opt3)
  source 1..1887: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7553 - RNA, 1887 nt, synthetic construct
  misc_feature 1..1887: note = mRNA product Design a-1 comprising derived and/or modified sequence from HRSV(A2)__F_DSCav1_mut8 (opt4)
  source 1..1887: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7554 - RNA, 1887 nt, synthetic construct
  misc_feature 1..1887: note = mRNA product Design a-1 comprising derived and/or modified sequence from HRSV(A2)__F_DSCav1_mut8 (opt5)
  source 1..1887: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7555 - RNA, 1887 nt, synthetic construct
  misc_feature 1..1887: note = mRNA product Design a-1 comprising derived and/or modified sequence from HRSV(A2)__F_DSCav1_mut8 (opt6)
  source 1..1887: mol_type = other RNA
gggagagtcccgcagtcggcgtccagcggctctgcttgttcgtgtgtgtgtcgttgcaggccttattcaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7556 - RNA, 1887 nt, synthetic construct
  misc_feature 1..1887: note = mRNA product Design a-1 comprising derived and/or modified sequence from HRSV(A2)__F_DSCav1_mut8 (opt11)
  source 1..1887: mol_type = other RNA
gggagagtcccgcagtcggcgtccagcggctctgcttgttcgtgtgtgtgtcgttgcaggccttattcaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7557 - RNA, 1906 nt, synthetic construct
  misc_feature 1..1906: note = mRNA product Design a-2 comprising derived and/or modified sequence from HRSV(A2)__F_DSCav1_mut8 (opt1)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7558 - RNA, 1906 nt, synthetic construct
  misc_feature 1..1906: note = mRNA product Design a-2 comprising derived and/or modified sequence from HRSV(A2)__F_DSCav1_mut8 (opt1)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7559 - RNA, 1906 nt, synthetic construct
  misc_feature 1..1906: note = mRNA product Design a-2 comprising derived and/or modified sequence from HRSV(A2)__F_DSCav1_mut8 (opt2)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7560 - RNA, 1906 nt, synthetic construct
  misc_feature 1..1906: note = mRNA product Design a-2 comprising derived and/or modified sequence from HRSV(A2)__F_DSCav1_mut8 (opt3)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7561 - RNA, 1906 nt, synthetic construct
  misc_feature 1..1906: note = mRNA product Design a-2 comprising derived and/or modified sequence from HRSV(A2)__F_DSCav1_mut8 (opt4)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7562 - RNA, 1906 nt, synthetic construct
  misc_feature 1..1906: note = mRNA product Design a-2 comprising derived and/or modified sequence from HRSV(A2)__F_DSCav1_mut8 (opt5)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7563 - RNA, 1906 nt, synthetic construct
  misc_feature 1..1906: note = mRNA product Design a-2 comprising derived and/or modified sequence from HRSV(A2)__F_DSCav1_mut8 (opt6)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7564 - RNA, 1906 nt, synthetic construct
  misc_feature 1..1906: note = mRNA product Design a-2 comprising derived and/or modified sequence from HRSV(A2)__F_DSCav1_mut8 (opt11)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7565 - RNA, 1984 nt, synthetic construct
  misc_feature 1..1984: note = mRNA product Design a-3 comprising derived and/or modified sequence from HRSV(A2)__F_DSCav1_mut8 (opt1)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7566 - RNA, 1984 nt, synthetic construct
  misc_feature 1..1984: note = mRNA product Design a-3 comprising derived and/or modified sequence from HRSV(A2)__F_DSCav1_mut8 (opt1)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7567 - RNA, 1984 nt, synthetic construct
  misc_feature 1..1984: note = mRNA product Design a-3 comprising derived and/or modified sequence from HRSV(A2)__F_DSCav1_mut8 (opt2)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7568 - RNA, 1984 nt, synthetic construct
  misc_feature 1..1984: note = mRNA product Design a-3 comprising derived and/or modified sequence from HRSV(A2)__F_DSCav1_mut8 (opt3)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7569 - RNA, 1984 nt, synthetic construct
  misc_feature 1..1984: note = mRNA product Design a-3 comprising derived and/or modified sequence from HRSV(A2)__F_DSCav1_mut8 (opt4)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7570 - RNA, 1984 nt, synthetic construct
  misc_feature 1..1984: note = mRNA product Design a-3 comprising derived and/or modified sequence from HRSV(A2)__F_DSCav1_mut8 (opt5)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7571 - RNA, 1984 nt, synthetic construct
  misc_feature 1..1984: note = mRNA product Design a-3 comprising derived and/or modified sequence from HRSV(A2)__F_DSCav1_mut8 (opt6)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7572 - RNA, 1984 nt, synthetic construct
  misc_feature 1..1984: note = mRNA product Design a-3 comprising derived and/or modified sequence from HRSV(A2)__F_DSCav1_mut8 (opt11)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7573 - RNA, 1933 nt, synthetic construct
  misc_feature 1..1933: note = mRNA product Design a-4 comprising derived and/or modified sequence from HRSV(A2)__F_DSCav1_mut8 (opt1)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7574 - RNA, 1933 nt, synthetic construct
  misc_feature 1..1933: note = mRNA product Design a-4 comprising derived and/or modified sequence from HRSV(A2)__F_DSCav1_mut8 (opt1)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7575 - RNA, 1933 nt, synthetic construct
  misc_feature 1..1933: note = mRNA product Design a-4 comprising derived and/or modified sequence from HRSV(A2)__F_DSCav1_mut8 (opt2)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7576 - RNA, 1933 nt, synthetic construct
  misc_feature 1..1933: note = mRNA product Design a-4 comprising derived and/or modified sequence from HRSV(A2)__F_DSCav1_mut8 (opt3)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7577 - RNA, 1933 nt, synthetic construct
  misc_feature 1..1933: note = mRNA product Design a-4 comprising derived and/or modified sequence from HRSV(A2)__F_DSCav1_mut8 (opt4)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7578 - RNA, 1933 nt, synthetic construct
  misc_feature 1..1933: note = mRNA product Design a-4 comprising derived and/or modified sequence from HRSV(A2)__F_DSCav1_mut8 (opt5)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7579 - RNA, 1933 nt, synthetic construct
  misc_feature 1..1933: note = mRNA product Design a-4 comprising derived and/or modified sequence from HRSV(A2)__F_DSCav1_mut8 (opt6)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7580 - RNA, 1933 nt, synthetic construct
  misc_feature 1..1933: note = mRNA product Design a-4 comprising derived and/or modified sequence from HRSV(A2)__F_DSCav1_mut8 (opt11)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7581 - RNA, 1879 nt, synthetic construct
  misc_feature 1..1879: note = mRNA product Design a-5 comprising derived and/or modified sequence from HRSV(A2)__F_DSCav1_mut8 (opt1)
  source 1..1879: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7582 - RNA, 1879 nt, synthetic construct
  misc_feature 1..1879: note = mRNA product Design a-5 comprising derived and/or modified sequence from HRSV(A2)__F_DSCav1_mut8 (opt1)
  source 1..1879: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7583 - RNA, 1879 nt, synthetic construct
  misc_feature 1..1879: note = mRNA product Design a-5 comprising derived and/or modified sequence from HRSV(A2)__F_DSCav1_mut8 (opt2)
  source 1..1879: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7584 - RNA, 1879 nt, synthetic construct
  misc_feature 1..1879: note = mRNA product Design a-5 comprising derived and/or modified sequence from HRSV(A2)__F_DSCav1_mut8 (opt3)
  source 1..1879: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7585 - RNA, 1879 nt, synthetic construct
  misc_feature 1..1879: note = mRNA product Design a-5 comprising derived and/or modified sequence from HRSV(A2)__F_DSCav1_mut8 (opt4)
  source 1..1879: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7586 - RNA, 1879 nt, synthetic construct
  misc_feature 1..1879: note = mRNA product Design a-5 comprising derived and/or modified sequence from HRSV(A2)__F_DSCav1_mut8 (opt5)
  source 1..1879: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7587 - RNA, 1879 nt, synthetic construct
  misc_feature 1..1879: note = mRNA product Design a-5 comprising derived and/or modified sequence from HRSV(A2)__F_DSCav1_mut8 (opt6)
  source 1..1879: mol_type = other RNA
gggagactttcccattctgtagcagaatttggtgttgcctgtggtcttggtcccgcggagaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7588 - RNA, 1879 nt, synthetic construct
  misc_feature 1..1879: note = mRNA product Design a-5 comprising derived and/or modified sequence from HRSV(A2)__F_DSCav1_mut8 (opt11)
  source 1..1879: mol_type = other RNA
gggagactttcccattctgtagcagaatttggtgttgcctgtggtcttggtcccgcggagaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7589 - RNA, 2060 nt, synthetic construct
  misc_feature 1..2060: note = mRNA product Design b-1 comprising derived and/or modified sequence from HRSV(A2)__F_DSCav1_mut8 (opt1)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7590 - RNA, 2060 nt, synthetic construct
  misc_feature 1..2060: note = mRNA product Design b-1 comprising derived and/or modified sequence from HRSV(A2)__F_DSCav1_mut8 (opt1)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7591 - RNA, 2060 nt, synthetic construct
  misc_feature 1..2060: note = mRNA product Design b-1 comprising derived and/or modified sequence from HRSV(A2)__F_DSCav1_mut8 (opt2)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7592 - RNA, 2060 nt, synthetic construct
  misc_feature 1..2060: note = mRNA product Design b-1 comprising derived and/or modified sequence from HRSV(A2)__F_DSCav1_mut8 (opt3)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7593 - RNA, 2060 nt, synthetic construct
  misc_feature 1..2060: note = mRNA product Design b-1 comprising derived and/or modified sequence from HRSV(A2)__F_DSCav1_mut8 (opt4)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7594 - RNA, 2060 nt, synthetic construct
  misc_feature 1..2060: note = mRNA product Design b-1 comprising derived and/or modified sequence from HRSV(A2)__F_DSCav1_mut8 (opt5)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7595 - RNA, 2060 nt, synthetic construct
  misc_feature 1..2060: note = mRNA product Design b-1 comprising derived and/or modified sequence from HRSV(A2)__F_DSCav1_mut8 (opt6)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7596 - RNA, 2060 nt, synthetic construct
  misc_feature 1..2060: note = mRNA product Design b-1 comprising derived and/or modified sequence from HRSV(A2)__F_DSCav1_mut8 (opt11)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7597 - RNA, 1880 nt, synthetic construct
  misc_feature 1..1880: note = mRNA product Design b-2 comprising derived and/or modified sequence from HRSV(A2)__F_DSCav1_mut8 (opt1)
  source 1..1880: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7598 - RNA, 1880 nt, synthetic construct
  misc_feature 1..1880: note = mRNA product Design b-2 comprising derived and/or modified sequence from HRSV(A2)__F_DSCav1_mut8 (opt1)
  source 1..1880: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7599 - RNA, 1880 nt, synthetic construct
  misc_feature 1..1880: note = mRNA product Design b-2 comprising derived and/or modified sequence from HRSV(A2)__F_DSCav1_mut8 (opt2)
  source 1..1880: mol_type = other RNA
gggagagcctctgctggagtccggggagtggcgttggctgctagagcgaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7600 - RNA, 1880 nt, synthetic construct
  misc_feature 1..1880: note = mRNA product Design b-2 comprising derived and/or modified sequence from HRSV(A2)__F_DSCav1_mut8 (opt3)
  source 1..1880: mol_type = other RNA
gggagagcctctgctggagtccggggagtggcgttggctgctagagcgaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7601 - RNA, 1880 nt, synthetic construct
  misc_feature 1..1880: note = mRNA product Design b-2 comprising derived and/or modified sequence from HRSV(A2)__F_DSCav1_mut8 (opt4)
  source 1..1880: mol_type = other RNA
gggagagcctctgctggagtccggggagtggcgttggctgctagagcgaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7602 - RNA, 1880 nt, synthetic construct
  misc_feature 1..1880: note = mRNA product Design b-2 comprising derived and/or modified sequence from HRSV(A2)__F_DSCav1_mut8 (opt5)
  source 1..1880: mol_type = other RNA
gggagagcctctgctggagtccggggagtggcgttggctgctagagcgaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7603 - RNA, 1880 nt, synthetic construct
  misc_feature 1..1880: note = mRNA product Design b-2 comprising derived and/or modified sequence from HRSV(A2)__F_DSCav1_mut8 (opt6)
  source 1..1880: mol_type = other RNA
gggagagcctctgctggagtccggggagtggcgttggctgctagagcgaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7604 - RNA, 1880 nt, synthetic construct
  misc_feature 1..1880: note = mRNA product Design b-2 comprising derived and/or modified sequence from HRSV(A2)__F_DSCav1_mut8 (opt11)
  source 1..1880: mol_type = other RNA
gggagagcctctgctggagtccggggagtggcgttggctgctagagcgaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7605 - RNA, 1900 nt, synthetic construct
  misc_feature 1..1900: note = mRNA product Design b-3 comprising derived and/or modified sequence from HRSV(A2)__F_DSCav1_mut8 (opt1)
  source 1..1900: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7606 - RNA, 1900 nt, synthetic construct
  misc_feature 1..1900: note = mRNA product Design b-3 comprising derived and/or modified sequence from HRSV(A2)__F_DSCav1_mut8 (opt1)
  source 1..1900: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7607 - RNA, 1900 nt, synthetic construct
  misc_feature 1..1900: note = mRNA product Design b-3 comprising derived and/or modified sequence from HRSV(A2)__F_DSCav1_mut8 (opt2)
  source 1..1900: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7608 - RNA, 1900 nt, synthetic construct
  misc_feature 1..1900: note = mRNA product Design b-3 comprising derived and/or modified sequence from HRSV(A2)__F_DSCav1_mut8 (opt3)
  source 1..1900: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7609 - RNA, 1900 nt, synthetic construct
  misc_feature 1..1900: note = mRNA product Design b-3 comprising derived and/or modified sequence from HRSV(A2)__F_DSCav1_mut8 (opt4)
  source 1..1900: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7610 - RNA, 1900 nt, synthetic construct
  misc_feature 1..1900: note = mRNA product Design b-3 comprising derived and/or modified sequence from HRSV(A2)__F_DSCav1_mut8 (opt5)
  source 1..1900: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7611 - RNA, 1900 nt, synthetic construct
  misc_feature 1..1900: note = mRNA product Design b-3 comprising derived and/or modified sequence from HRSV(A2)__F_DSCav1_mut8 (opt6)
  source 1..1900: mol_type = other RNA
gggagagtcccgcagtcggcgtccagcggctctgcttgttcgtgtgtgtgtcgttgcaggccttattcaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7612 - RNA, 1900 nt, synthetic construct
  misc_feature 1..1900: note = mRNA product Design b-3 comprising derived and/or modified sequence from HRSV(A2)__F_DSCav1_mut8 (opt11)
  source 1..1900: mol_type = other RNA
gggagagtcccgcagtcggcgtccagcggctctgcttgttcgtgtgtgtgtcgttgcaggccttattcaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7613 - RNA, 1951 nt, synthetic construct
  misc_feature 1..1951: note = mRNA product Design b-4 comprising derived and/or modified sequence from HRSV(A2)__F_DSCav1_mut8 (opt1)
  source 1..1951: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7614 - RNA, 1951 nt, synthetic construct
  misc_feature 1..1951: note = mRNA product Design b-4 comprising derived and/or modified sequence from HRSV(A2)__F_DSCav1_mut8 (opt1)
  source 1..1951: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7615 - RNA, 1951 nt, synthetic construct
  misc_feature 1..1951: note = mRNA product Design b-4 comprising derived and/or modified sequence from HRSV(A2)__F_DSCav1_mut8 (opt2)
  source 1..1951: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7616 - RNA, 1951 nt, synthetic construct
  misc_feature 1..1951: note = mRNA product Design b-4 comprising derived and/or modified sequence from HRSV(A2)__F_DSCav1_mut8 (opt3)
  source 1..1951: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7617 - RNA, 1951 nt, synthetic construct
  misc_feature 1..1951: note = mRNA product Design b-4 comprising derived and/or modified sequence from HRSV(A2)__F_DSCav1_mut8 (opt4)
  source 1..1951: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7618 - RNA, 1951 nt, synthetic construct
  misc_feature 1..1951: note = mRNA product Design b-4 comprising derived and/or modified sequence from HRSV(A2)__F_DSCav1_mut8 (opt5)
  source 1..1951: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7619 - RNA, 1951 nt, synthetic construct
  misc_feature 1..1951: note = mRNA product Design b-4 comprising derived and/or modified sequence from HRSV(A2)__F_DSCav1_mut8 (opt6)
  source 1..1951: mol_type = other RNA
gggagagtcccgcagtcggcgtccagcggctctgcttgttcgtgtgtgtgtcgttgcaggccttattcaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7620 - RNA, 1951 nt, synthetic construct
  misc_feature 1..1951: note = mRNA product Design b-4 comprising derived and/or modified sequence from HRSV(A2)__F_DSCav1_mut8 (opt11)
  source 1..1951: mol_type = other RNA
gggagagtcccgcagtcggcgtccagcggctctgcttgttcgtgtgtgtgtcgttgcaggccttattcaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7621 - RNA, 2013 nt, synthetic construct
  misc_feature 1..2013: note = mRNA product Design b-5 comprising derived and/or modified sequence from HRSV(A2)__F_DSCav1_mut8 (opt1)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7622 - RNA, 2013 nt, synthetic construct
  misc_feature 1..2013: note = mRNA product Design b-5 comprising derived and/or modified sequence from HRSV(A2)__F_DSCav1_mut8 (opt1)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7623 - RNA, 2013 nt, synthetic construct
  misc_feature 1..2013: note = mRNA product Design b-5 comprising derived and/or modified sequence from HRSV(A2)__F_DSCav1_mut8 (opt2)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7624 - RNA, 2013 nt, synthetic construct
  misc_feature 1..2013: note = mRNA product Design b-5 comprising derived and/or modified sequence from HRSV(A2)__F_DSCav1_mut8 (opt3)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7625 - RNA, 2013 nt, synthetic construct
  misc_feature 1..2013: note = mRNA product Design b-5 comprising derived and/or modified sequence from HRSV(A2)__F_DSCav1_mut8 (opt4)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7626 - RNA, 2013 nt, synthetic construct
  misc_feature 1..2013: note = mRNA product Design b-5 comprising derived and/or modified sequence from HRSV(A2)__F_DSCav1_mut8 (opt5)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7627 - RNA, 2013 nt, synthetic construct
  misc_feature 1..2013: note = mRNA product Design b-5 comprising derived and/or modified sequence from HRSV(A2)__F_DSCav1_mut8 (opt6)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7628 - RNA, 2013 nt, synthetic construct
  misc_feature 1..2013: note = mRNA product Design b-5 comprising derived and/or modified sequence from HRSV(A2)__F_DSCav1_mut8 (opt11)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7629 - RNA, 1919 nt, synthetic construct
  misc_feature 1..1919: note = mRNA product Design c-1 comprising derived and/or modified sequence from HRSV(A2)__F_DSCav1_mut8 (opt1)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7630 - RNA, 1919 nt, synthetic construct
  misc_feature 1..1919: note = mRNA product Design c-1 comprising derived and/or modified sequence from HRSV(A2)__F_DSCav1_mut8 (opt1)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7631 - RNA, 1919 nt, synthetic construct
  misc_feature 1..1919: note = mRNA product Design c-1 comprising derived and/or modified sequence from HRSV(A2)__F_DSCav1_mut8 (opt2)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7632 - RNA, 1919 nt, synthetic construct
  misc_feature 1..1919: note = mRNA product Design c-1 comprising derived and/or modified sequence from HRSV(A2)__F_DSCav1_mut8 (opt3)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7633 - RNA, 1919 nt, synthetic construct
  misc_feature 1..1919: note = mRNA product Design c-1 comprising derived and/or modified sequence from HRSV(A2)__F_DSCav1_mut8 (opt4)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7634 - RNA, 1919 nt, synthetic construct
  misc_feature 1..1919: note = mRNA product Design c-1 comprising derived and/or modified sequence from HRSV(A2)__F_DSCav1_mut8 (opt5)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7635 - RNA, 1919 nt, synthetic construct
  misc_feature 1..1919: note = mRNA product Design c-1 comprising derived and/or modified sequence from HRSV(A2)__F_DSCav1_mut8 (opt6)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7636 - RNA, 1919 nt, synthetic construct
  misc_feature 1..1919: note = mRNA product Design c-1 comprising derived and/or modified sequence from HRSV(A2)__F_DSCav1_mut8 (opt11)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7637 - RNA, 2009 nt, synthetic construct
  misc_feature 1..2009: note = mRNA product Design c-2 comprising derived and/or modified sequence from HRSV(A2)__F_DSCav1_mut8 (opt1)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7638 - RNA, 2009 nt, synthetic construct
  misc_feature 1..2009: note = mRNA product Design c-2 comprising derived and/or modified sequence from HRSV(A2)__F_DSCav1_mut8 (opt1)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7639 - RNA, 2009 nt, synthetic construct
  misc_feature 1..2009: note = mRNA product Design c-2 comprising derived and/or modified sequence from HRSV(A2)__F_DSCav1_mut8 (opt2)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7640 - RNA, 2009 nt, synthetic construct
  misc_feature 1..2009: note = mRNA product Design c-2 comprising derived and/or modified sequence from HRSV(A2)__F_DSCav1_mut8 (opt3)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7641 - RNA, 2009 nt, synthetic construct
  misc_feature 1..2009: note = mRNA product Design c-2 comprising derived and/or modified sequence from HRSV(A2)__F_DSCav1_mut8 (opt4)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7642 - RNA, 2009 nt, synthetic construct
  misc_feature 1..2009: note = mRNA product Design c-2 comprising derived and/or modified sequence from HRSV(A2)__F_DSCav1_mut8 (opt5)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7643 - RNA, 2009 nt, synthetic construct
  misc_feature 1..2009: note = mRNA product Design c-2 comprising derived and/or modified sequence from HRSV(A2)__F_DSCav1_mut8 (opt6)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7644 - RNA, 2009 nt, synthetic construct
  misc_feature 1..2009: note = mRNA product Design c-2 comprising derived and/or modified sequence from HRSV(A2)__F_DSCav1_mut8 (opt11)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7645 - RNA, 1986 nt, synthetic construct
  misc_feature 1..1986: note = mRNA product Design c-3 comprising derived and/or modified sequence from HRSV(A2)__F_DSCav1_mut8 (opt1)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7646 - RNA, 1986 nt, synthetic construct
  misc_feature 1..1986: note = mRNA product Design c-3 comprising derived and/or modified sequence from HRSV(A2)__F_DSCav1_mut8 (opt1)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7647 - RNA, 1986 nt, synthetic construct
  misc_feature 1..1986: note = mRNA product Design c-3 comprising derived and/or modified sequence from HRSV(A2)__F_DSCav1_mut8 (opt2)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7648 - RNA, 1986 nt, synthetic construct
  misc_feature 1..1986: note = mRNA product Design c-3 comprising derived and/or modified sequence from HRSV(A2)__F_DSCav1_mut8 (opt3)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7649 - RNA, 1986 nt, synthetic construct
  misc_feature 1..1986: note = mRNA product Design c-3 comprising derived and/or modified sequence from HRSV(A2)__F_DSCav1_mut8 (opt4)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7650 - RNA, 1986 nt, synthetic construct
  misc_feature 1..1986: note = mRNA product Design c-3 comprising derived and/or modified sequence from HRSV(A2)__F_DSCav1_mut8 (opt5)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7651 - RNA, 1986 nt, synthetic construct
  misc_feature 1..1986: note = mRNA product Design c-3 comprising derived and/or modified sequence from HRSV(A2)__F_DSCav1_mut8 (opt6)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7652 - RNA, 1986 nt, synthetic construct
  misc_feature 1..1986: note = mRNA product Design c-3 comprising derived and/or modified sequence from HRSV(A2)__F_DSCav1_mut8 (opt11)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7653 - RNA, 1982 nt, synthetic construct
  misc_feature 1..1982: note = mRNA product Design c-4 comprising derived and/or modified sequence from HRSV(A2)__F_DSCav1_mut8 (opt1)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7654 - RNA, 1982 nt, synthetic construct
  misc_feature 1..1982: note = mRNA product Design c-4 comprising derived and/or modified sequence from HRSV(A2)__F_DSCav1_mut8 (opt1)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7655 - RNA, 1982 nt, synthetic construct
  misc_feature 1..1982: note = mRNA product Design c-4 comprising derived and/or modified sequence from HRSV(A2)__F_DSCav1_mut8 (opt2)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7656 - RNA, 1982 nt, synthetic construct
  misc_feature 1..1982: note = mRNA product Design c-4 comprising derived and/or modified sequence from HRSV(A2)__F_DSCav1_mut8 (opt3)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7657 - RNA, 1982 nt, synthetic construct
  misc_feature 1..1982: note = mRNA product Design c-4 comprising derived and/or modified sequence from HRSV(A2)__F_DSCav1_mut8 (opt4)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7658 - RNA, 1982 nt, synthetic construct
  misc_feature 1..1982: note = mRNA product Design c-4 comprising derived and/or modified sequence from HRSV(A2)__F_DSCav1_mut8 (opt5)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7659 - RNA, 1982 nt, synthetic construct
  misc_feature 1..1982: note = mRNA product Design c-4 comprising derived and/or modified sequence from HRSV(A2)__F_DSCav1_mut8 (opt6)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7660 - RNA, 1982 nt, synthetic construct
  misc_feature 1..1982: note = mRNA product Design c-4 comprising derived and/or modified sequence from HRSV(A2)__F_DSCav1_mut8 (opt11)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7661 - RNA, 1900 nt, synthetic construct
  misc_feature 1..1900: note = mRNA product Design c-5 comprising derived and/or modified sequence from HRSV(A2)__F_DSCav1_mut8 (opt1)
  source 1..1900: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7662 - RNA, 1900 nt, synthetic construct
  misc_feature 1..1900: note = mRNA product Design c-5 comprising derived and/or modified sequence from HRSV(A2)__F_DSCav1_mut8 (opt1)
  source 1..1900: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7663 - RNA, 1900 nt, synthetic construct
  misc_feature 1..1900: note = mRNA product Design c-5 comprising derived and/or modified sequence from HRSV(A2)__F_DSCav1_mut8 (opt2)
  source 1..1900: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7664 - RNA, 1900 nt, synthetic construct
  misc_feature 1..1900: note = mRNA product Design c-5 comprising derived and/or modified sequence from HRSV(A2)__F_DSCav1_mut8 (opt3)
  source 1..1900: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7665 - RNA, 1900 nt, synthetic construct
  misc_feature 1..1900: note = mRNA product Design c-5 comprising derived and/or modified sequence from HRSV(A2)__F_DSCav1_mut8 (opt4)
  source 1..1900: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7666 - RNA, 1900 nt, synthetic construct
  misc_feature 1..1900: note = mRNA product Design c-5 comprising derived and/or modified sequence from HRSV(A2)__F_DSCav1_mut8 (opt5)
  source 1..1900: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7667 - RNA, 1900 nt, synthetic construct
  misc_feature 1..1900: note = mRNA product Design c-5 comprising derived and/or modified sequence from HRSV(A2)__F_DSCav1_mut8 (opt6)
  source 1..1900: mol_type = other RNA
gggagagcggctcggccattttgtcccagtcagtccggaggctgcggctgcagaagtaccgcctgcggagtaactgcaaagaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7668 - RNA, 1900 nt, synthetic construct
  misc_feature 1..1900: note = mRNA product Design c-5 comprising derived and/or modified sequence from HRSV(A2)__F_DSCav1_mut8 (opt11)
  source 1..1900: mol_type = other RNA
gggagagcggctcggccattttgtcccagtcagtccggaggctgcggctgcagaagtaccgcctgcggagtaactgcaaagaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7669 - RNA, 1909 nt, synthetic construct
  misc_feature 1..1909: note = mRNA product Design d-1 comprising derived and/or modified sequence from HRSV(A2)__F_DSCav1_mut8 (opt1)
  source 1..1909: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7670 - RNA, 1909 nt, synthetic construct
  misc_feature 1..1909: note = mRNA product Design d-1 comprising derived and/or modified sequence from HRSV(A2)__F_DSCav1_mut8 (opt1)
  source 1..1909: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7671 - RNA, 1909 nt, synthetic construct
  misc_feature 1..1909: note = mRNA product Design d-1 comprising derived and/or modified sequence from HRSV(A2)__F_DSCav1_mut8 (opt2)
  source 1..1909: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7672 - RNA, 1909 nt, synthetic construct
  misc_feature 1..1909: note = mRNA product Design d-1 comprising derived and/or modified sequence from HRSV(A2)__F_DSCav1_mut8 (opt3)
  source 1..1909: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7673 - RNA, 1909 nt, synthetic construct
  misc_feature 1..1909: note = mRNA product Design d-1 comprising derived and/or modified sequence from HRSV(A2)__F_DSCav1_mut8 (opt4)
  source 1..1909: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7674 - RNA, 1909 nt, synthetic construct
  misc_feature 1..1909: note = mRNA product Design d-1 comprising derived and/or modified sequence from HRSV(A2)__F_DSCav1_mut8 (opt5)
  source 1..1909: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7675 - RNA, 1909 nt, synthetic construct
  misc_feature 1..1909: note = mRNA product Design d-1 comprising derived and/or modified sequence from HRSV(A2)__F_DSCav1_mut8 (opt6)
  source 1..1909: mol_type = other RNA
gggagacccgtgacccggaagttgtacggctacgcgactttccctcccacaaaccctcgcgcccttcctttcctacttgggcccggcagaaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7676 - RNA, 1909 nt, synthetic construct
  misc_feature 1..1909: note = mRNA product Design d-1 comprising derived and/or modified sequence from HRSV(A2)__F_DSCav1_mut8 (opt11)
  source 1..1909: mol_type = other RNA
gggagacccgtgacccggaagttgtacggctacgcgactttccctcccacaaaccctcgcgcccttcctttcctacttgggcccggcagaaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7677 - RNA, 1964 nt, synthetic construct
  misc_feature 1..1964: note = mRNA product Design d-2 comprising derived and/or modified sequence from HRSV(A2)__F_DSCav1_mut8 (opt1)
  source 1..1964: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7678 - RNA, 1964 nt, synthetic construct
  misc_feature 1..1964: note = mRNA product Design d-2 comprising derived and/or modified sequence from HRSV(A2)__F_DSCav1_mut8 (opt1)
  source 1..1964: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7679 - RNA, 1964 nt, synthetic construct
  misc_feature 1..1964: note = mRNA product Design d-2 comprising derived and/or modified sequence from HRSV(A2)__F_DSCav1_mut8 (opt2)
  source 1..1964: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7680 - RNA, 1964 nt, synthetic construct
  misc_feature 1..1964: note = mRNA product Design d-2 comprising derived and/or modified sequence from HRSV(A2)__F_DSCav1_mut8 (opt3)
  source 1..1964: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7681 - RNA, 1964 nt, synthetic construct
  misc_feature 1..1964: note = mRNA product Design d-2 comprising derived and/or modified sequence from HRSV(A2)__F_DSCav1_mut8 (opt4)
  source 1..1964: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7682 - RNA, 1964 nt, synthetic construct
  misc_feature 1..1964: note = mRNA product Design d-2 comprising derived and/or modified sequence from HRSV(A2)__F_DSCav1_mut8 (opt5)
  source 1..1964: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7683 - RNA, 1964 nt, synthetic construct
  misc_feature 1..1964: note = mRNA product Design d-2 comprising derived and/or modified sequence from HRSV(A2)__F_DSCav1_mut8 (opt6)
  source 1..1964: mol_type = other RNA
gggagagcggctcggccattttgtcccagtcagtccggaggctgcggctgcagaagtaccgcctgcggagtaactgcaaagaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7684 - RNA, 1964 nt, synthetic construct
  misc_feature 1..1964: note = mRNA product Design d-2 comprising derived and/or modified sequence from HRSV(A2)__F_DSCav1_mut8 (opt11)
  source 1..1964: mol_type = other RNA
gggagagcggctcggccattttgtcccagtcagtccggaggctgcggctgcagaagtaccgcctgcggagtaactgcaaagaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7685 - RNA, 2280 nt, synthetic construct
  misc_feature 1..2280: note = mRNA product Design d-3 comprising derived and/or modified sequence from HRSV(A2)__F_DSCav1_mut8 (opt1)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7686 - RNA, 2280 nt, synthetic construct
  misc_feature 1..2280: note = mRNA product Design d-3 comprising derived and/or modified sequence from HRSV(A2)__F_DSCav1_mut8 (opt1)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7687 - RNA, 2280 nt, synthetic construct
  misc_feature 1..2280: note = mRNA product Design d-3 comprising derived and/or modified sequence from HRSV(A2)__F_DSCav1_mut8 (opt2)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7688 - RNA, 2280 nt, synthetic construct
  misc_feature 1..2280: note = mRNA product Design d-3 comprising derived and/or modified sequence from HRSV(A2)__F_DSCav1_mut8 (opt3)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7689 - RNA, 2280 nt, synthetic construct
  misc_feature 1..2280: note = mRNA product Design d-3 comprising derived and/or modified sequence from HRSV(A2)__F_DSCav1_mut8 (opt4)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7690 - RNA, 2280 nt, synthetic construct
  misc_feature 1..2280: note = mRNA product Design d-3 comprising derived and/or modified sequence from HRSV(A2)__F_DSCav1_mut8 (opt5)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7691 - RNA, 2280 nt, synthetic construct
  misc_feature 1..2280: note = mRNA product Design d-3 comprising derived and/or modified sequence from HRSV(A2)__F_DSCav1_mut8 (opt6)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7692 - RNA, 2280 nt, synthetic construct
  misc_feature 1..2280: note = mRNA product Design d-3 comprising derived and/or modified sequence from HRSV(A2)__F_DSCav1_mut8 (opt11)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7693 - RNA, 1963 nt, synthetic construct
  misc_feature 1..1963: note = mRNA product Design d-4 comprising derived and/or modified sequence from HRSV(A2)__F_DSCav1_mut8 (opt1)
  source 1..1963: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7694 - RNA, 1963 nt, synthetic construct
  misc_feature 1..1963: note = mRNA product Design d-4 comprising derived and/or modified sequence from HRSV(A2)__F_DSCav1_mut8 (opt1)
  source 1..1963: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7695 - RNA, 1963 nt, synthetic construct
  misc_feature 1..1963: note = mRNA product Design d-4 comprising derived and/or modified sequence from HRSV(A2)__F_DSCav1_mut8 (opt2)
  source 1..1963: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7696 - RNA, 1963 nt, synthetic construct
  misc_feature 1..1963: note = mRNA product Design d-4 comprising derived and/or modified sequence from HRSV(A2)__F_DSCav1_mut8 (opt3)
  source 1..1963: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7697 - RNA, 1963 nt, synthetic construct
  misc_feature 1..1963: note = mRNA product Design d-4 comprising derived and/or modified sequence from HRSV(A2)__F_DSCav1_mut8 (opt4)
  source 1..1963: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7698 - RNA, 1963 nt, synthetic construct
  misc_feature 1..1963: note = mRNA product Design d-4 comprising derived and/or modified sequence from HRSV(A2)__F_DSCav1_mut8 (opt5)
  source 1..1963: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7699 - RNA, 1963 nt, synthetic construct
  misc_feature 1..1963: note = mRNA product Design d-4 comprising derived and/or modified sequence from HRSV(A2)__F_DSCav1_mut8 (opt6)
  source 1..1963: mol_type = other RNA
gggagagtcccgcagtcggcgtccagcggctctgcttgttcgtgtgtgtgtcgttgcaggccttattcaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7700 - RNA, 1963 nt, synthetic construct
  misc_feature 1..1963: note = mRNA product Design d-4 comprising derived and/or modified sequence from HRSV(A2)__F_DSCav1_mut8 (opt11)
  source 1..1963: mol_type = other RNA
gggagagtcccgcagtcggcgtccagcggctctgcttgttcgtgtgtgtgtcgttgcaggccttattcaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7701 - RNA, 2060 nt, synthetic construct
  misc_feature 1..2060: note = mRNA product Design d-5 comprising derived and/or modified sequence from HRSV(A2)__F_DSCav1_mut8 (opt1)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7702 - RNA, 2060 nt, synthetic construct
  misc_feature 1..2060: note = mRNA product Design d-5 comprising derived and/or modified sequence from HRSV(A2)__F_DSCav1_mut8 (opt1)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7703 - RNA, 2060 nt, synthetic construct
  misc_feature 1..2060: note = mRNA product Design d-5 comprising derived and/or modified sequence from HRSV(A2)__F_DSCav1_mut8 (opt2)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7704 - RNA, 2060 nt, synthetic construct
  misc_feature 1..2060: note = mRNA product Design d-5 comprising derived and/or modified sequence from HRSV(A2)__F_DSCav1_mut8 (opt3)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7705 - RNA, 2060 nt, synthetic construct
  misc_feature 1..2060: note = mRNA product Design d-5 comprising derived and/or modified sequence from HRSV(A2)__F_DSCav1_mut8 (opt4)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7706 - RNA, 2060 nt, synthetic construct
  misc_feature 1..2060: note = mRNA product Design d-5 comprising derived and/or modified sequence from HRSV(A2)__F_DSCav1_mut8 (opt5)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7707 - RNA, 2060 nt, synthetic construct
  misc_feature 1..2060: note = mRNA product Design d-5 comprising derived and/or modified sequence from HRSV(A2)__F_DSCav1_mut8 (opt6)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7708 - RNA, 2060 nt, synthetic construct
  misc_feature 1..2060: note = mRNA product Design d-5 comprising derived and/or modified sequence from HRSV(A2)__F_DSCav1_mut8 (opt11)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7709 - RNA, 1940 nt, synthetic construct
  misc_feature 1..1940: note = mRNA product Design e-1 comprising derived and/or modified sequence from HRSV(A2)__F_DSCav1_mut8 (opt1)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7710 - RNA, 1940 nt, synthetic construct
  misc_feature 1..1940: note = mRNA product Design e-1 comprising derived and/or modified sequence from HRSV(A2)__F_DSCav1_mut8 (opt1)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7711 - RNA, 1940 nt, synthetic construct
  misc_feature 1..1940: note = mRNA product Design e-1 comprising derived and/or modified sequence from HRSV(A2)__F_DSCav1_mut8 (opt2)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7712 - RNA, 1940 nt, synthetic construct
  misc_feature 1..1940: note = mRNA product Design e-1 comprising derived and/or modified sequence from HRSV(A2)__F_DSCav1_mut8 (opt3)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7713 - RNA, 1940 nt, synthetic construct
  misc_feature 1..1940: note = mRNA product Design e-1 comprising derived and/or modified sequence from HRSV(A2)__F_DSCav1_mut8 (opt4)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7714 - RNA, 1940 nt, synthetic construct
  misc_feature 1..1940: note = mRNA product Design e-1 comprising derived and/or modified sequence from HRSV(A2)__F_DSCav1_mut8 (opt5)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7715 - RNA, 1940 nt, synthetic construct
  misc_feature 1..1940: note = mRNA product Design e-1 comprising derived and/or modified sequence from HRSV(A2)__F_DSCav1_mut8 (opt6)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7716 - RNA, 1940 nt, synthetic construct
  misc_feature 1..1940: note = mRNA product Design e-1 comprising derived and/or modified sequence from HRSV(A2)__F_DSCav1_mut8 (opt11)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7717 - RNA, 1922 nt, synthetic construct
  misc_feature 1..1922: note = mRNA product Design e-2 comprising derived and/or modified sequence from HRSV(A2)__F_DSCav1_mut8 (opt1)
  source 1..1922: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7718 - RNA, 1922 nt, synthetic construct
  misc_feature 1..1922: note = mRNA product Design e-2 comprising derived and/or modified sequence from HRSV(A2)__F_DSCav1_mut8 (opt1)
  source 1..1922: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7719 - RNA, 1922 nt, synthetic construct
  misc_feature 1..1922: note = mRNA product Design e-2 comprising derived and/or modified sequence from HRSV(A2)__F_DSCav1_mut8 (opt2)
  source 1..1922: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7720 - RNA, 1922 nt, synthetic construct
  misc_feature 1..1922: note = mRNA product Design e-2 comprising derived and/or modified sequence from HRSV(A2)__F_DSCav1_mut8 (opt3)
  source 1..1922: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7721 - RNA, 1922 nt, synthetic construct
  misc_feature 1..1922: note = mRNA product Design e-2 comprising derived and/or modified sequence from HRSV(A2)__F_DSCav1_mut8 (opt4)
  source 1..1922: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7722 - RNA, 1922 nt, synthetic construct
  misc_feature 1..1922: note = mRNA product Design e-2 comprising derived and/or modified sequence from HRSV(A2)__F_DSCav1_mut8 (opt5)
  source 1..1922: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7723 - RNA, 1922 nt, synthetic construct
  misc_feature 1..1922: note = mRNA product Design e-2 comprising derived and/or modified sequence from HRSV(A2)__F_DSCav1_mut8 (opt6)
  source 1..1922: mol_type = other RNA
gggagacccgtgacccggaagttgtacggctacgcgactttccctcccacaaaccctcgcgcccttcctttcctacttgggcccggcagaaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7724 - RNA, 1922 nt, synthetic construct
  misc_feature 1..1922: note = mRNA product Design e-2 comprising derived and/or modified sequence from HRSV(A2)__F_DSCav1_mut8 (opt11)
  source 1..1922: mol_type = other RNA
gggagacccgtgacccggaagttgtacggctacgcgactttccctcccacaaaccctcgcgcccttcctttcctacttgggcccggcagaaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7725 - RNA, 1892 nt, synthetic construct
  misc_feature 1..1892: note = mRNA product Design e-3 comprising derived and/or modified sequence from HRSV(A2)__F_DSCav1_mut8 (opt1)
  source 1..1892: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7726 - RNA, 1892 nt, synthetic construct
  misc_feature 1..1892: note = mRNA product Design e-3 comprising derived and/or modified sequence from HRSV(A2)__F_DSCav1_mut8 (opt1)
  source 1..1892: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7727 - RNA, 1892 nt, synthetic construct
  misc_feature 1..1892: note = mRNA product Design e-3 comprising derived and/or modified sequence from HRSV(A2)__F_DSCav1_mut8 (opt2)
  source 1..1892: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7728 - RNA, 1892 nt, synthetic construct
  misc_feature 1..1892: note = mRNA product Design e-3 comprising derived and/or modified sequence from HRSV(A2)__F_DSCav1_mut8 (opt3)
  source 1..1892: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7729 - RNA, 1892 nt, synthetic construct
  misc_feature 1..1892: note = mRNA product Design e-3 comprising derived and/or modified sequence from HRSV(A2)__F_DSCav1_mut8 (opt4)
  source 1..1892: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7730 - RNA, 1892 nt, synthetic construct
  misc_feature 1..1892: note = mRNA product Design e-3 comprising derived and/or modified sequence from HRSV(A2)__F_DSCav1_mut8 (opt5)
  source 1..1892: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7731 - RNA, 1892 nt, synthetic construct
  misc_feature 1..1892: note = mRNA product Design e-3 comprising derived and/or modified sequence from HRSV(A2)__F_DSCav1_mut8 (opt6)
  source 1..1892: mol_type = other RNA
gggagactttcccattctgtagcagaatttggtgttgcctgtggtcttggtcccgcggagaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7732 - RNA, 1892 nt, synthetic construct
  misc_feature 1..1892: note = mRNA product Design e-3 comprising derived and/or modified sequence from HRSV(A2)__F_DSCav1_mut8 (opt11)
  source 1..1892: mol_type = other RNA
gggagactttcccattctgtagcagaatttggtgttgcctgtggtcttggtcccgcggagaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7733 - RNA, 1946 nt, synthetic construct
  misc_feature 1..1946: note = mRNA product Design e-4 comprising derived and/or modified sequence from HRSV(A2)__F_DSCav1_mut8 (opt1)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7734 - RNA, 1946 nt, synthetic construct
  misc_feature 1..1946: note = mRNA product Design e-4 comprising derived and/or modified sequence from HRSV(A2)__F_DSCav1_mut8 (opt1)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7735 - RNA, 1946 nt, synthetic construct
  misc_feature 1..1946: note = mRNA product Design e-4 comprising derived and/or modified sequence from HRSV(A2)__F_DSCav1_mut8 (opt2)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7736 - RNA, 1946 nt, synthetic construct
  misc_feature 1..1946: note = mRNA product Design e-4 comprising derived and/or modified sequence from HRSV(A2)__F_DSCav1_mut8 (opt3)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7737 - RNA, 1946 nt, synthetic construct
  misc_feature 1..1946: note = mRNA product Design e-4 comprising derived and/or modified sequence from HRSV(A2)__F_DSCav1_mut8 (opt4)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7738 - RNA, 1946 nt, synthetic construct
  misc_feature 1..1946: note = mRNA product Design e-4 comprising derived and/or modified sequence from HRSV(A2)__F_DSCav1_mut8 (opt5)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7739 - RNA, 1946 nt, synthetic construct
  misc_feature 1..1946: note = mRNA product Design e-4 comprising derived and/or modified sequence from HRSV(A2)__F_DSCav1_mut8 (opt6)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7740 - RNA, 1946 nt, synthetic construct
  misc_feature 1..1946: note = mRNA product Design e-4 comprising derived and/or modified sequence from HRSV(A2)__F_DSCav1_mut8 (opt11)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7741 - RNA, 1913 nt, synthetic construct
  misc_feature 1..1913: note = mRNA product Design e-5 comprising derived and/or modified sequence from HRSV(A2)__F_DSCav1_mut8 (opt1)
  source 1..1913: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7742 - RNA, 1913 nt, synthetic construct
  misc_feature 1..1913: note = mRNA product Design e-5 comprising derived and/or modified sequence from HRSV(A2)__F_DSCav1_mut8 (opt1)
  source 1..1913: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7743 - RNA, 1913 nt, synthetic construct
  misc_feature 1..1913: note = mRNA product Design e-5 comprising derived and/or modified sequence from HRSV(A2)__F_DSCav1_mut8 (opt2)
  source 1..1913: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7744 - RNA, 1913 nt, synthetic construct
  misc_feature 1..1913: note = mRNA product Design e-5 comprising derived and/or modified sequence from HRSV(A2)__F_DSCav1_mut8 (opt3)
  source 1..1913: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7745 - RNA, 1913 nt, synthetic construct
  misc_feature 1..1913: note = mRNA product Design e-5 comprising derived and/or modified sequence from HRSV(A2)__F_DSCav1_mut8 (opt4)
  source 1..1913: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7746 - RNA, 1913 nt, synthetic construct
  misc_feature 1..1913: note = mRNA product Design e-5 comprising derived and/or modified sequence from HRSV(A2)__F_DSCav1_mut8 (opt5)
  source 1..1913: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7747 - RNA, 1913 nt, synthetic construct
  misc_feature 1..1913: note = mRNA product Design e-5 comprising derived and/or modified sequence from HRSV(A2)__F_DSCav1_mut8 (opt6)
  source 1..1913: mol_type = other RNA
gggagagcggctcggccattttgtcccagtcagtccggaggctgcggctgcagaagtaccgcctgcggagtaactgcaaagaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7748 - RNA, 1913 nt, synthetic construct
  misc_feature 1..1913: note = mRNA product Design e-5 comprising derived and/or modified sequence from HRSV(A2)__F_DSCav1_mut8 (opt11)
  source 1..1913: mol_type = other RNA
gggagagcggctcggccattttgtcccagtcagtccggaggctgcggctgcagaagtaccgcctgcggagtaactgcaaagaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7749 - RNA, 1980 nt, synthetic construct
  misc_feature 1..1980: note = mRNA product Design e-6 comprising derived and/or modified sequence from HRSV(A2)__F_DSCav1_mut8 (opt1)
  source 1..1980: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7750 - RNA, 1980 nt, synthetic construct
  misc_feature 1..1980: note = mRNA product Design e-6 comprising derived and/or modified sequence from HRSV(A2)__F_DSCav1_mut8 (opt1)
  source 1..1980: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7751 - RNA, 1980 nt, synthetic construct
  misc_feature 1..1980: note = mRNA product Design e-6 comprising derived and/or modified sequence from HRSV(A2)__F_DSCav1_mut8 (opt2)
  source 1..1980: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7752 - RNA, 1980 nt, synthetic construct
  misc_feature 1..1980: note = mRNA product Design e-6 comprising derived and/or modified sequence from HRSV(A2)__F_DSCav1_mut8 (opt3)
  source 1..1980: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7753 - RNA, 1980 nt, synthetic construct
  misc_feature 1..1980: note = mRNA product Design e-6 comprising derived and/or modified sequence from HRSV(A2)__F_DSCav1_mut8 (opt4)
  source 1..1980: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7754 - RNA, 1980 nt, synthetic construct
  misc_feature 1..1980: note = mRNA product Design e-6 comprising derived and/or modified sequence from HRSV(A2)__F_DSCav1_mut8 (opt5)
  source 1..1980: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7755 - RNA, 1980 nt, synthetic construct
  misc_feature 1..1980: note = mRNA product Design e-6 comprising derived and/or modified sequence from HRSV(A2)__F_DSCav1_mut8 (opt6)
  source 1..1980: mol_type = other RNA
gggagagcggctcggccattttgtcccagtcagtccggaggctgcggctgcagaagtaccgcctgcggagtaactgcaaagaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7756 - RNA, 1980 nt, synthetic construct
  misc_feature 1..1980: note = mRNA product Design e-6 comprising derived and/or modified sequence from HRSV(A2)__F_DSCav1_mut8 (opt11)
  source 1..1980: mol_type = other RNA
gggagagcggctcggccattttgtcccagtcagtccggaggctgcggctgcagaagtaccgcctgcggagtaactgcaaagaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7757 - RNA, 2196 nt, synthetic construct
  misc_feature 1..2196: note = mRNA product Design f-1 comprising derived and/or modified sequence from HRSV(A2)__F_DSCav1_mut8 (opt1)
  source 1..2196: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7758 - RNA, 2196 nt, synthetic construct
  misc_feature 1..2196: note = mRNA product Design f-1 comprising derived and/or modified sequence from HRSV(A2)__F_DSCav1_mut8 (opt1)
  source 1..2196: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7759 - RNA, 2196 nt, synthetic construct
  misc_feature 1..2196: note = mRNA product Design f-1 comprising derived and/or modified sequence from HRSV(A2)__F_DSCav1_mut8 (opt2)
  source 1..2196: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7760 - RNA, 2196 nt, synthetic construct
  misc_feature 1..2196: note = mRNA product Design f-1 comprising derived and/or modified sequence from HRSV(A2)__F_DSCav1_mut8 (opt3)
  source 1..2196: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7761 - RNA, 2196 nt, synthetic construct
  misc_feature 1..2196: note = mRNA product Design f-1 comprising derived and/or modified sequence from HRSV(A2)__F_DSCav1_mut8 (opt4)
  source 1..2196: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7762 - RNA, 2196 nt, synthetic construct
  misc_feature 1..2196: note = mRNA product Design f-1 comprising derived and/or modified sequence from HRSV(A2)__F_DSCav1_mut8 (opt5)
  source 1..2196: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7763 - RNA, 2196 nt, synthetic construct
  misc_feature 1..2196: note = mRNA product Design f-1 comprising derived and/or modified sequence from HRSV(A2)__F_DSCav1_mut8 (opt6)
  source 1..2196: mol_type = other RNA
gggagagcggctcggccattttgtcccagtcagtccggaggctgcggctgcagaagtaccgcctgcggagtaactgcaaagaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7764 - RNA, 2196 nt, synthetic construct
  misc_feature 1..2196: note = mRNA product Design f-1 comprising derived and/or modified sequence from HRSV(A2)__F_DSCav1_mut8 (opt11)
  source 1..2196: mol_type = other RNA
gggagagcggctcggccattttgtcccagtcagtccggaggctgcggctgcagaagtaccgcctgcggagtaactgcaaagaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7765 - RNA, 1976 nt, synthetic construct
  misc_feature 1..1976: note = mRNA product Design f-2 comprising derived and/or modified sequence from HRSV(A2)__F_DSCav1_mut8 (opt1)
  source 1..1976: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7766 - RNA, 1976 nt, synthetic construct
  misc_feature 1..1976: note = mRNA product Design f-2 comprising derived and/or modified sequence from HRSV(A2)__F_DSCav1_mut8 (opt1)
  source 1..1976: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7767 - RNA, 1976 nt, synthetic construct
  misc_feature 1..1976: note = mRNA product Design f-2 comprising derived and/or modified sequence from HRSV(A2)__F_DSCav1_mut8 (opt2)
  source 1..1976: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7768 - RNA, 1976 nt, synthetic construct
  misc_feature 1..1976: note = mRNA product Design f-2 comprising derived and/or modified sequence from HRSV(A2)__F_DSCav1_mut8 (opt3)
  source 1..1976: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7769 - RNA, 1976 nt, synthetic construct
  misc_feature 1..1976: note = mRNA product Design f-2 comprising derived and/or modified sequence from HRSV(A2)__F_DSCav1_mut8 (opt4)
  source 1..1976: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7770 - RNA, 1976 nt, synthetic construct
  misc_feature 1..1976: note = mRNA product Design f-2 comprising derived and/or modified sequence from HRSV(A2)__F_DSCav1_mut8 (opt5)
  source 1..1976: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7771 - RNA, 1976 nt, synthetic construct
  misc_feature 1..1976: note = mRNA product Design f-2 comprising derived and/or modified sequence from HRSV(A2)__F_DSCav1_mut8 (opt6)
  source 1..1976: mol_type = other RNA
gggagagcggctcggccattttgtcccagtcagtccggaggctgcggctgcagaagtaccgcctgcggagtaactgcaaagaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7772 - RNA, 1976 nt, synthetic construct
  misc_feature 1..1976: note = mRNA product Design f-2 comprising derived and/or modified sequence from HRSV(A2)__F_DSCav1_mut8 (opt11)
  source 1..1976: mol_type = other RNA
gggagagcggctcggccattttgtcccagtcagtccggaggctgcggctgcagaagtaccgcctgcggagtaactgcaaagaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7773 - RNA, 1967 nt, synthetic construct
  misc_feature 1..1967: note = mRNA product Design f-3 comprising derived and/or modified sequence from HRSV(A2)__F_DSCav1_mut8 (opt1)
  source 1..1967: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7774 - RNA, 1967 nt, synthetic construct
  misc_feature 1..1967: note = mRNA product Design f-3 comprising derived and/or modified sequence from HRSV(A2)__F_DSCav1_mut8 (opt1)
  source 1..1967: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7775 - RNA, 1967 nt, synthetic construct
  misc_feature 1..1967: note = mRNA product Design f-3 comprising derived and/or modified sequence from HRSV(A2)__F_DSCav1_mut8 (opt2)
  source 1..1967: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7776 - RNA, 1967 nt, synthetic construct
  misc_feature 1..1967: note = mRNA product Design f-3 comprising derived and/or modified sequence from HRSV(A2)__F_DSCav1_mut8 (opt3)
  source 1..1967: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7777 - RNA, 1967 nt, synthetic construct
  misc_feature 1..1967: note = mRNA product Design f-3 comprising derived and/or modified sequence from HRSV(A2)__F_DSCav1_mut8 (opt4)
  source 1..1967: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7778 - RNA, 1967 nt, synthetic construct
  misc_feature 1..1967: note = mRNA product Design f-3 comprising derived and/or modified sequence from HRSV(A2)__F_DSCav1_mut8 (opt5)
  source 1..1967: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7779 - RNA, 1967 nt, synthetic construct
  misc_feature 1..1967: note = mRNA product Design f-3 comprising derived and/or modified sequence from HRSV(A2)__F_DSCav1_mut8 (opt6)
  source 1..1967: mol_type = other RNA
gggagagtcccgcagtcggcgtccagcggctctgcttgttcgtgtgtgtgtcgttgcaggccttattcaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7780 - RNA, 1967 nt, synthetic construct
  misc_feature 1..1967: note = mRNA product Design f-3 comprising derived and/or modified sequence from HRSV(A2)__F_DSCav1_mut8 (opt11)
  source 1..1967: mol_type = other RNA
gggagagtcccgcagtcggcgtccagcggctctgcttgttcgtgtgtgtgtcgttgcaggccttattcaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7781 - RNA, 2183 nt, synthetic construct
  misc_feature 1..2183: note = mRNA product Design f-4 comprising derived and/or modified sequence from HRSV(A2)__F_DSCav1_mut8 (opt1)
  source 1..2183: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7782 - RNA, 2183 nt, synthetic construct
  misc_feature 1..2183: note = mRNA product Design f-4 comprising derived and/or modified sequence from HRSV(A2)__F_DSCav1_mut8 (opt1)
  source 1..2183: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7783 - RNA, 2183 nt, synthetic construct
  misc_feature 1..2183: note = mRNA product Design f-4 comprising derived and/or modified sequence from HRSV(A2)__F_DSCav1_mut8 (opt2)
  source 1..2183: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7784 - RNA, 2183 nt, synthetic construct
  misc_feature 1..2183: note = mRNA product Design f-4 comprising derived and/or modified sequence from HRSV(A2)__F_DSCav1_mut8 (opt3)
  source 1..2183: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7785 - RNA, 2183 nt, synthetic construct
  misc_feature 1..2183: note = mRNA product Design f-4 comprising derived and/or modified sequence from HRSV(A2)__F_DSCav1_mut8 (opt4)
  source 1..2183: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7786 - RNA, 2183 nt, synthetic construct
  misc_feature 1..2183: note = mRNA product Design f-4 comprising derived and/or modified sequence from HRSV(A2)__F_DSCav1_mut8 (opt5)
  source 1..2183: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7787 - RNA, 2183 nt, synthetic construct
  misc_feature 1..2183: note = mRNA product Design f-4 comprising derived and/or modified sequence from HRSV(A2)__F_DSCav1_mut8 (opt6)
  source 1..2183: mol_type = other RNA
gggagagtcccgcagtcggcgtccagcggctctgcttgttcgtgtgtgtgtcgttgcaggccttattcaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7788 - RNA, 2183 nt, synthetic construct
  misc_feature 1..2183: note = mRNA product Design f-4 comprising derived and/or modified sequence from HRSV(A2)__F_DSCav1_mut8 (opt11)
  source 1..2183: mol_type = other RNA
gggagagtcccgcagtcggcgtccagcggctctgcttgttcgtgtgtgtgtcgttgcaggccttattcaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7789 - RNA, 1959 nt, synthetic construct
  misc_feature 1..1959: note = mRNA product Design f-5 comprising derived and/or modified sequence from HRSV(A2)__F_DSCav1_mut8 (opt1)
  source 1..1959: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7790 - RNA, 1959 nt, synthetic construct
  misc_feature 1..1959: note = mRNA product Design f-5 comprising derived and/or modified sequence from HRSV(A2)__F_DSCav1_mut8 (opt1)
  source 1..1959: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7791 - RNA, 1959 nt, synthetic construct
  misc_feature 1..1959: note = mRNA product Design f-5 comprising derived and/or modified sequence from HRSV(A2)__F_DSCav1_mut8 (opt2)
  source 1..1959: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7792 - RNA, 1959 nt, synthetic construct
  misc_feature 1..1959: note = mRNA product Design f-5 comprising derived and/or modified sequence from HRSV(A2)__F_DSCav1_mut8 (opt3)
  source 1..1959: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7793 - RNA, 1959 nt, synthetic construct
  misc_feature 1..1959: note = mRNA product Design f-5 comprising derived and/or modified sequence from HRSV(A2)__F_DSCav1_mut8 (opt4)
  source 1..1959: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7794 - RNA, 1959 nt, synthetic construct
  misc_feature 1..1959: note = mRNA product Design f-5 comprising derived and/or modified sequence from HRSV(A2)__F_DSCav1_mut8 (opt5)
  source 1..1959: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7795 - RNA, 1959 nt, synthetic construct
  misc_feature 1..1959: note = mRNA product Design f-5 comprising derived and/or modified sequence from HRSV(A2)__F_DSCav1_mut8 (opt6)
  source 1..1959: mol_type = other RNA
gggagactttcccattctgtagcagaatttggtgttgcctgtggtcttggtcccgcggagaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7796 - RNA, 1959 nt, synthetic construct
  misc_feature 1..1959: note = mRNA product Design f-5 comprising derived and/or modified sequence from HRSV(A2)__F_DSCav1_mut8 (opt11)
  source 1..1959: mol_type = other RNA
gggagactttcccattctgtagcagaatttggtgttgcctgtggtcttggtcccgcggagaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7797 - RNA, 1955 nt, synthetic construct
  misc_feature 1..1955: note = mRNA product Design g-1 comprising derived and/or modified sequence from HRSV(A2)__F_DSCav1_mut8 (opt1)
  source 1..1955: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7798 - RNA, 1955 nt, synthetic construct
  misc_feature 1..1955: note = mRNA product Design g-1 comprising derived and/or modified sequence from HRSV(A2)__F_DSCav1_mut8 (opt1)
  source 1..1955: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7799 - RNA, 1955 nt, synthetic construct
  misc_feature 1..1955: note = mRNA product Design g-1 comprising derived and/or modified sequence from HRSV(A2)__F_DSCav1_mut8 (opt2)
  source 1..1955: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7800 - RNA, 1955 nt, synthetic construct
  misc_feature 1..1955: note = mRNA product Design g-1 comprising derived and/or modified sequence from HRSV(A2)__F_DSCav1_mut8 (opt3)
  source 1..1955: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7801 - RNA, 1955 nt, synthetic construct
  misc_feature 1..1955: note = mRNA product Design g-1 comprising derived and/or modified sequence from HRSV(A2)__F_DSCav1_mut8 (opt4)
  source 1..1955: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7802 - RNA, 1955 nt, synthetic construct
  misc_feature 1..1955: note = mRNA product Design g-1 comprising derived and/or modified sequence from HRSV(A2)__F_DSCav1_mut8 (opt5)
  source 1..1955: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7803 - RNA, 1955 nt, synthetic construct
  misc_feature 1..1955: note = mRNA product Design g-1 comprising derived and/or modified sequence from HRSV(A2)__F_DSCav1_mut8 (opt6)
  source 1..1955: mol_type = other RNA
gggagactttcccattctgtagcagaatttggtgttgcctgtggtcttggtcccgcggagaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7804 - RNA, 1955 nt, synthetic construct
  misc_feature 1..1955: note = mRNA product Design g-1 comprising derived and/or modified sequence from HRSV(A2)__F_DSCav1_mut8 (opt11)
  source 1..1955: mol_type = other RNA
gggagactttcccattctgtagcagaatttggtgttgcctgtggtcttggtcccgcggagaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7805 - RNA, 1970 nt, synthetic construct
  misc_feature 1..1970: note = mRNA product Design g-2 comprising derived and/or modified sequence from HRSV(A2)__F_DSCav1_mut8 (opt1)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7806 - RNA, 1970 nt, synthetic construct
  misc_feature 1..1970: note = mRNA product Design g-2 comprising derived and/or modified sequence from HRSV(A2)__F_DSCav1_mut8 (opt1)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7807 - RNA, 1970 nt, synthetic construct
  misc_feature 1..1970: note = mRNA product Design g-2 comprising derived and/or modified sequence from HRSV(A2)__F_DSCav1_mut8 (opt2)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7808 - RNA, 1970 nt, synthetic construct
  misc_feature 1..1970: note = mRNA product Design g-2 comprising derived and/or modified sequence from HRSV(A2)__F_DSCav1_mut8 (opt3)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7809 - RNA, 1970 nt, synthetic construct
  misc_feature 1..1970: note = mRNA product Design g-2 comprising derived and/or modified sequence from HRSV(A2)__F_DSCav1_mut8 (opt4)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7810 - RNA, 1970 nt, synthetic construct
  misc_feature 1..1970: note = mRNA product Design g-2 comprising derived and/or modified sequence from HRSV(A2)__F_DSCav1_mut8 (opt5)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7811 - RNA, 1970 nt, synthetic construct
  misc_feature 1..1970: note = mRNA product Design g-2 comprising derived and/or modified sequence from HRSV(A2)__F_DSCav1_mut8 (opt6)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7812 - RNA, 1970 nt, synthetic construct
  misc_feature 1..1970: note = mRNA product Design g-2 comprising derived and/or modified sequence from HRSV(A2)__F_DSCav1_mut8 (opt11)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7813 - RNA, 2202 nt, synthetic construct
  misc_feature 1..2202: note = mRNA product Design g-3 comprising derived and/or modified sequence from HRSV(A2)__F_DSCav1_mut8 (opt1)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7814 - RNA, 2202 nt, synthetic construct
  misc_feature 1..2202: note = mRNA product Design g-3 comprising derived and/or modified sequence from HRSV(A2)__F_DSCav1_mut8 (opt1)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7815 - RNA, 2202 nt, synthetic construct
  misc_feature 1..2202: note = mRNA product Design g-3 comprising derived and/or modified sequence from HRSV(A2)__F_DSCav1_mut8 (opt2)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7816 - RNA, 2202 nt, synthetic construct
  misc_feature 1..2202: note = mRNA product Design g-3 comprising derived and/or modified sequence from HRSV(A2)__F_DSCav1_mut8 (opt3)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7817 - RNA, 2202 nt, synthetic construct
  misc_feature 1..2202: note = mRNA product Design g-3 comprising derived and/or modified sequence from HRSV(A2)__F_DSCav1_mut8 (opt4)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7818 - RNA, 2202 nt, synthetic construct
  misc_feature 1..2202: note = mRNA product Design g-3 comprising derived and/or modified sequence from HRSV(A2)__F_DSCav1_mut8 (opt5)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7819 - RNA, 2202 nt, synthetic construct
  misc_feature 1..2202: note = mRNA product Design g-3 comprising derived and/or modified sequence from HRSV(A2)__F_DSCav1_mut8 (opt6)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7820 - RNA, 2202 nt, synthetic construct
  misc_feature 1..2202: note = mRNA product Design g-3 comprising derived and/or modified sequence from HRSV(A2)__F_DSCav1_mut8 (opt11)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7821 - RNA, 1997 nt, synthetic construct
  misc_feature 1..1997: note = mRNA product Design g-4 comprising derived and/or modified sequence from HRSV(A2)__F_DSCav1_mut8 (opt1)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7822 - RNA, 1997 nt, synthetic construct
  misc_feature 1..1997: note = mRNA product Design g-4 comprising derived and/or modified sequence from HRSV(A2)__F_DSCav1_mut8 (opt1)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7823 - RNA, 1997 nt, synthetic construct
  misc_feature 1..1997: note = mRNA product Design g-4 comprising derived and/or modified sequence from HRSV(A2)__F_DSCav1_mut8 (opt2)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7824 - RNA, 1997 nt, synthetic construct
  misc_feature 1..1997: note = mRNA product Design g-4 comprising derived and/or modified sequence from HRSV(A2)__F_DSCav1_mut8 (opt3)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7825 - RNA, 1997 nt, synthetic construct
  misc_feature 1..1997: note = mRNA product Design g-4 comprising derived and/or modified sequence from HRSV(A2)__F_DSCav1_mut8 (opt4)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7826 - RNA, 1997 nt, synthetic construct
  misc_feature 1..1997: note = mRNA product Design g-4 comprising derived and/or modified sequence from HRSV(A2)__F_DSCav1_mut8 (opt5)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7827 - RNA, 1997 nt, synthetic construct
  misc_feature 1..1997: note = mRNA product Design g-4 comprising derived and/or modified sequence from HRSV(A2)__F_DSCav1_mut8 (opt6)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7828 - RNA, 1997 nt, synthetic construct
  misc_feature 1..1997: note = mRNA product Design g-4 comprising derived and/or modified sequence from HRSV(A2)__F_DSCav1_mut8 (opt11)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7829 - RNA, 1973 nt, synthetic construct
  misc_feature 1..1973: note = mRNA product Design g-5 comprising derived and/or modified sequence from HRSV(A2)__F_DSCav1_mut8 (opt1)
  source 1..1973: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7830 - RNA, 1973 nt, synthetic construct
  misc_feature 1..1973: note = mRNA product Design g-5 comprising derived and/or modified sequence from HRSV(A2)__F_DSCav1_mut8 (opt1)
  source 1..1973: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7831 - RNA, 1973 nt, synthetic construct
  misc_feature 1..1973: note = mRNA product Design g-5 comprising derived and/or modified sequence from HRSV(A2)__F_DSCav1_mut8 (opt2)
  source 1..1973: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7832 - RNA, 1973 nt, synthetic construct
  misc_feature 1..1973: note = mRNA product Design g-5 comprising derived and/or modified sequence from HRSV(A2)__F_DSCav1_mut8 (opt3)
  source 1..1973: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7833 - RNA, 1973 nt, synthetic construct
  misc_feature 1..1973: note = mRNA product Design g-5 comprising derived and/or modified sequence from HRSV(A2)__F_DSCav1_mut8 (opt4)
  source 1..1973: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7834 - RNA, 1973 nt, synthetic construct
  misc_feature 1..1973: note = mRNA product Design g-5 comprising derived and/or modified sequence from HRSV(A2)__F_DSCav1_mut8 (opt5)
  source 1..1973: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7835 - RNA, 1973 nt, synthetic construct
  misc_feature 1..1973: note = mRNA product Design g-5 comprising derived and/or modified sequence from HRSV(A2)__F_DSCav1_mut8 (opt6)
  source 1..1973: mol_type = other RNA
gggagacccgtgacccggaagttgtacggctacgcgactttccctcccacaaaccctcgcgcccttcctttcctacttgggcccggcagaaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7836 - RNA, 1973 nt, synthetic construct
  misc_feature 1..1973: note = mRNA product Design g-5 comprising derived and/or modified sequence from HRSV(A2)__F_DSCav1_mut8 (opt11)
  source 1..1973: mol_type = other RNA
gggagacccgtgacccggaagttgtacggctacgcgactttccctcccacaaaccctcgcgcccttcctttcctacttgggcccggcagaaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7837 - RNA, 1989 nt, synthetic construct
  misc_feature 1..1989: note = mRNA product Design h-1 comprising derived and/or modified sequence from HRSV(A2)__F_DSCav1_mut8 (opt1)
  source 1..1989: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7838 - RNA, 1989 nt, synthetic construct
  misc_feature 1..1989: note = mRNA product Design h-1 comprising derived and/or modified sequence from HRSV(A2)__F_DSCav1_mut8 (opt1)
  source 1..1989: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7839 - RNA, 1989 nt, synthetic construct
  misc_feature 1..1989: note = mRNA product Design h-1 comprising derived and/or modified sequence from HRSV(A2)__F_DSCav1_mut8 (opt2)
  source 1..1989: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7840 - RNA, 1989 nt, synthetic construct
  misc_feature 1..1989: note = mRNA product Design h-1 comprising derived and/or modified sequence from HRSV(A2)__F_DSCav1_mut8 (opt3)
  source 1..1989: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7841 - RNA, 1989 nt, synthetic construct
  misc_feature 1..1989: note = mRNA product Design h-1 comprising derived and/or modified sequence from HRSV(A2)__F_DSCav1_mut8 (opt4)
  source 1..1989: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7842 - RNA, 1989 nt, synthetic construct
  misc_feature 1..1989: note = mRNA product Design h-1 comprising derived and/or modified sequence from HRSV(A2)__F_DSCav1_mut8 (opt5)
  source 1..1989: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7843 - RNA, 1989 nt, synthetic construct
  misc_feature 1..1989: note = mRNA product Design h-1 comprising derived and/or modified sequence from HRSV(A2)__F_DSCav1_mut8 (opt6)
  source 1..1989: mol_type = other RNA
gggagacccgtgacccggaagttgtacggctacgcgactttccctcccacaaaccctcgcgcccttcctttcctacttgggcccggcagaaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7844 - RNA, 1989 nt, synthetic construct
  misc_feature 1..1989: note = mRNA product Design h-1 comprising derived and/or modified sequence from HRSV(A2)__F_DSCav1_mut8 (opt11)
  source 1..1989: mol_type = other RNA
gggagacccgtgacccggaagttgtacggctacgcgactttccctcccacaaaccctcgcgcccttcctttcctacttgggcccggcagaaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7845 - RNA, 2205 nt, synthetic construct
  misc_feature 1..2205: note = mRNA product Design h-2 comprising derived and/or modified sequence from HRSV(A2)__F_DSCav1_mut8 (opt1)
  source 1..2205: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7846 - RNA, 2205 nt, synthetic construct
  misc_feature 1..2205: note = mRNA product Design h-2 comprising derived and/or modified sequence from HRSV(A2)__F_DSCav1_mut8 (opt1)
  source 1..2205: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7847 - RNA, 2205 nt, synthetic construct
  misc_feature 1..2205: note = mRNA product Design h-2 comprising derived and/or modified sequence from HRSV(A2)__F_DSCav1_mut8 (opt2)
  source 1..2205: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7848 - RNA, 2205 nt, synthetic construct
  misc_feature 1..2205: note = mRNA product Design h-2 comprising derived and/or modified sequence from HRSV(A2)__F_DSCav1_mut8 (opt3)
  source 1..2205: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7849 - RNA, 2205 nt, synthetic construct
  misc_feature 1..2205: note = mRNA product Design h-2 comprising derived and/or modified sequence from HRSV(A2)__F_DSCav1_mut8 (opt4)
  source 1..2205: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7850 - RNA, 2205 nt, synthetic construct
  misc_feature 1..2205: note = mRNA product Design h-2 comprising derived and/or modified sequence from HRSV(A2)__F_DSCav1_mut8 (opt5)
  source 1..2205: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7851 - RNA, 2205 nt, synthetic construct
  misc_feature 1..2205: note = mRNA product Design h-2 comprising derived and/or modified sequence from HRSV(A2)__F_DSCav1_mut8 (opt6)
  source 1..2205: mol_type = other RNA
gggagacccgtgacccggaagttgtacggctacgcgactttccctcccacaaaccctcgcgcccttcctttcctacttgggcccggcagaaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7852 - RNA, 2205 nt, synthetic construct
  misc_feature 1..2205: note = mRNA product Design h-2 comprising derived and/or modified sequence from HRSV(A2)__F_DSCav1_mut8 (opt11)
  source 1..2205: mol_type = other RNA
gggagacccgtgacccggaagttgtacggctacgcgactttccctcccacaaaccctcgcgcccttcctttcctacttgggcccggcagaaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7853 - RNA, 1985 nt, synthetic construct
  misc_feature 1..1985: note = mRNA product Design h-3 comprising derived and/or modified sequence from HRSV(A2)__F_DSCav1_mut8 (opt1)
  source 1..1985: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7854 - RNA, 1985 nt, synthetic construct
  misc_feature 1..1985: note = mRNA product Design h-3 comprising derived and/or modified sequence from HRSV(A2)__F_DSCav1_mut8 (opt1)
  source 1..1985: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7855 - RNA, 1985 nt, synthetic construct
  misc_feature 1..1985: note = mRNA product Design h-3 comprising derived and/or modified sequence from HRSV(A2)__F_DSCav1_mut8 (opt2)
  source 1..1985: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7856 - RNA, 1985 nt, synthetic construct
  misc_feature 1..1985: note = mRNA product Design h-3 comprising derived and/or modified sequence from HRSV(A2)__F_DSCav1_mut8 (opt3)
  source 1..1985: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7857 - RNA, 1985 nt, synthetic construct
  misc_feature 1..1985: note = mRNA product Design h-3 comprising derived and/or modified sequence from HRSV(A2)__F_DSCav1_mut8 (opt4)
  source 1..1985: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7858 - RNA, 1985 nt, synthetic construct
  misc_feature 1..1985: note = mRNA product Design h-3 comprising derived and/or modified sequence from HRSV(A2)__F_DSCav1_mut8 (opt5)
  source 1..1985: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7859 - RNA, 1985 nt, synthetic construct
  misc_feature 1..1985: note = mRNA product Design h-3 comprising derived and/or modified sequence from HRSV(A2)__F_DSCav1_mut8 (opt6)
  source 1..1985: mol_type = other RNA
gggagacccgtgacccggaagttgtacggctacgcgactttccctcccacaaaccctcgcgcccttcctttcctacttgggcccggcagaaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7860 - RNA, 1985 nt, synthetic construct
  misc_feature 1..1985: note = mRNA product Design h-3 comprising derived and/or modified sequence from HRSV(A2)__F_DSCav1_mut8 (opt11)
  source 1..1985: mol_type = other RNA
gggagacccgtgacccggaagttgtacggctacgcgactttccctcccacaaaccctcgcgcccttcctttcctacttgggcccggcagaaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7861 - RNA, 2048 nt, synthetic construct
  misc_feature 1..2048: note = mRNA product Design h-4 comprising derived and/or modified sequence from HRSV(A2)__F_DSCav1_mut8 (opt1)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7862 - RNA, 2048 nt, synthetic construct
  misc_feature 1..2048: note = mRNA product Design h-4 comprising derived and/or modified sequence from HRSV(A2)__F_DSCav1_mut8 (opt1)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7863 - RNA, 2048 nt, synthetic construct
  misc_feature 1..2048: note = mRNA product Design h-4 comprising derived and/or modified sequence from HRSV(A2)__F_DSCav1_mut8 (opt2)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7864 - RNA, 2048 nt, synthetic construct
  misc_feature 1..2048: note = mRNA product Design h-4 comprising derived and/or modified sequence from HRSV(A2)__F_DSCav1_mut8 (opt3)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7865 - RNA, 2048 nt, synthetic construct
  misc_feature 1..2048: note = mRNA product Design h-4 comprising derived and/or modified sequence from HRSV(A2)__F_DSCav1_mut8 (opt4)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7866 - RNA, 2048 nt, synthetic construct
  misc_feature 1..2048: note = mRNA product Design h-4 comprising derived and/or modified sequence from HRSV(A2)__F_DSCav1_mut8 (opt5)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7867 - RNA, 2048 nt, synthetic construct
  misc_feature 1..2048: note = mRNA product Design h-4 comprising derived and/or modified sequence from HRSV(A2)__F_DSCav1_mut8 (opt6)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7868 - RNA, 2048 nt, synthetic construct
  misc_feature 1..2048: note = mRNA product Design h-4 comprising derived and/or modified sequence from HRSV(A2)__F_DSCav1_mut8 (opt11)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7869 - RNA, 2064 nt, synthetic construct
  misc_feature 1..2064: note = mRNA product Design h-5 comprising derived and/or modified sequence from HRSV(A2)__F_DSCav1_mut8 (opt1)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7870 - RNA, 2064 nt, synthetic construct
  misc_feature 1..2064: note = mRNA product Design h-5 comprising derived and/or modified sequence from HRSV(A2)__F_DSCav1_mut8 (opt1)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7871 - RNA, 2064 nt, synthetic construct
  misc_feature 1..2064: note = mRNA product Design h-5 comprising derived and/or modified sequence from HRSV(A2)__F_DSCav1_mut8 (opt2)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7872 - RNA, 2064 nt, synthetic construct
  misc_feature 1..2064: note = mRNA product Design h-5 comprising derived and/or modified sequence from HRSV(A2)__F_DSCav1_mut8 (opt3)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7873 - RNA, 2064 nt, synthetic construct
  misc_feature 1..2064: note = mRNA product Design h-5 comprising derived and/or modified sequence from HRSV(A2)__F_DSCav1_mut8 (opt4)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7874 - RNA, 2064 nt, synthetic construct
  misc_feature 1..2064: note = mRNA product Design h-5 comprising derived and/or modified sequence from HRSV(A2)__F_DSCav1_mut8 (opt5)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7875 - RNA, 2064 nt, synthetic construct
  misc_feature 1..2064: note = mRNA product Design h-5 comprising derived and/or modified sequence from HRSV(A2)__F_DSCav1_mut8 (opt6)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7876 - RNA, 2064 nt, synthetic construct
  misc_feature 1..2064: note = mRNA product Design h-5 comprising derived and/or modified sequence from HRSV(A2)__F_DSCav1_mut8 (opt11)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7877 - RNA, 1997 nt, synthetic construct
  misc_feature 1..1997: note = mRNA product Design i-1 comprising derived and/or modified sequence from HRSV(A2)__F_DSCav1_mut8 (opt1)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7878 - RNA, 1997 nt, synthetic construct
  misc_feature 1..1997: note = mRNA product Design i-1 comprising derived and/or modified sequence from HRSV(A2)__F_DSCav1_mut8 (opt1)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7879 - RNA, 1997 nt, synthetic construct
  misc_feature 1..1997: note = mRNA product Design i-1 comprising derived and/or modified sequence from HRSV(A2)__F_DSCav1_mut8 (opt2)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7880 - RNA, 1997 nt, synthetic construct
  misc_feature 1..1997: note = mRNA product Design i-1 comprising derived and/or modified sequence from HRSV(A2)__F_DSCav1_mut8 (opt3)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7881 - RNA, 1997 nt, synthetic construct
  misc_feature 1..1997: note = mRNA product Design i-1 comprising derived and/or modified sequence from HRSV(A2)__F_DSCav1_mut8 (opt4)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7882 - RNA, 1997 nt, synthetic construct
  misc_feature 1..1997: note = mRNA product Design i-1 comprising derived and/or modified sequence from HRSV(A2)__F_DSCav1_mut8 (opt5)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7883 - RNA, 1997 nt, synthetic construct
  misc_feature 1..1997: note = mRNA product Design i-1 comprising derived and/or modified sequence from HRSV(A2)__F_DSCav1_mut8 (opt6)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7884 - RNA, 1997 nt, synthetic construct
  misc_feature 1..1997: note = mRNA product Design i-1 comprising derived and/or modified sequence from HRSV(A2)__F_DSCav1_mut8 (opt11)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7885 - RNA, 1997 nt, synthetic construct
  misc_feature 1..1997: note = mRNA product Design i-2 comprising derived and/or modified sequence from HRSV(A2)__F_DSCav1_mut8 (opt1)
  source 1..1997: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7886 - RNA, 1997 nt, synthetic construct
  misc_feature 1..1997: note = mRNA product Design i-2 comprising derived and/or modified sequence from HRSV(A2)__F_DSCav1_mut8 (opt1)
  source 1..1997: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7887 - RNA, 1997 nt, synthetic construct
  misc_feature 1..1997: note = mRNA product Design i-2 comprising derived and/or modified sequence from HRSV(A2)__F_DSCav1_mut8 (opt2)
  source 1..1997: mol_type = other RNA
gggagaggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7888 - RNA, 1997 nt, synthetic construct
  misc_feature 1..1997: note = mRNA product Design i-2 comprising derived and/or modified sequence from HRSV(A2)__F_DSCav1_mut8 (opt3)
  source 1..1997: mol_type = other RNA
gggagaggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7889 - RNA, 1997 nt, synthetic construct
  misc_feature 1..1997: note = mRNA product Design i-2 comprising derived and/or modified sequence from HRSV(A2)__F_DSCav1_mut8 (opt4)
  source 1..1997: mol_type = other RNA
gggagaggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7890 - RNA, 1997 nt, synthetic construct
  misc_feature 1..1997: note = mRNA product Design i-2 comprising derived and/or modified sequence from HRSV(A2)__F_DSCav1_mut8 (opt5)
  source 1..1997: mol_type = other RNA
gggagaggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7891 - RNA, 1997 nt, synthetic construct
  misc_feature 1..1997: note = mRNA product Design i-2 comprising derived and/or modified sequence from HRSV(A2)__F_DSCav1_mut8 (opt6)
  source 1..1997: mol_type = other RNA
gggagaggcgctgcctacggaggtggcagccatctccttctcggcatcaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7892 - RNA, 1997 nt, synthetic construct
  misc_feature 1..1997: note = mRNA product Design i-2 comprising derived and/or modified sequence from HRSV(A2)__F_DSCav1_mut8 (opt11)
  source 1..1997: mol_type = other RNA
gggagaggcgctgcctacggaggtggcagccatctccttctcggcatcaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7893 - RNA, 1993 nt, synthetic construct
  misc_feature 1..1993: note = mRNA product Design i-2 comprising derived and/or modified sequence from HRSV(A2)__F_DSCav1_mut8 (opt1)
  source 1..1993: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7894 - RNA, 1993 nt, synthetic construct
  misc_feature 1..1993: note = mRNA product Design i-2 comprising derived and/or modified sequence from HRSV(A2)__F_DSCav1_mut8 (opt1)
  source 1..1993: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7895 - RNA, 1993 nt, synthetic construct
  misc_feature 1..1993: note = mRNA product Design i-2 comprising derived and/or modified sequence from HRSV(A2)__F_DSCav1_mut8 (opt2)
  source 1..1993: mol_type = other RNA
ggggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7896 - RNA, 1993 nt, synthetic construct
  misc_feature 1..1993: note = mRNA product Design i-2 comprising derived and/or modified sequence from HRSV(A2)__F_DSCav1_mut8 (opt3)
  source 1..1993: mol_type = other RNA
ggggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7897 - RNA, 1993 nt, synthetic construct
  misc_feature 1..1993: note = mRNA product Design i-2 comprising derived and/or modified sequence from HRSV(A2)__F_DSCav1_mut8 (opt4)
  source 1..1993: mol_type = other RNA
ggggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7898 - RNA, 1993 nt, synthetic construct
  misc_feature 1..1993: note = mRNA product Design i-2 comprising derived and/or modified sequence from HRSV(A2)__F_DSCav1_mut8 (opt5)
  source 1..1993: mol_type = other RNA
ggggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7899 - RNA, 1993 nt, synthetic construct
  misc_feature 1..1993: note = mRNA product Design i-2 comprising derived and/or modified sequence from HRSV(A2)__F_DSCav1_mut8 (opt6)
  source 1..1993: mol_type = other RNA
ggggcgctgcctacggaggtggcagccatctccttctcggcatcaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7900 - RNA, 1993 nt, synthetic construct
  misc_feature 1..1993: note = mRNA product Design i-2 comprising derived and/or modified sequence from HRSV(A2)__F_DSCav1_mut8 (opt11)
  source 1..1993: mol_type = other RNA
ggggcgctgcctacggaggtggcagccatctccttctcggcatcaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7901 - RNA, 1828 nt, synthetic construct
  misc_feature 1..1828: note = mRNA product Design i-3 comprising derived and/or modified sequence from HRSV(A2)__F_DSCav1_mut8 (opt1)
  source 1..1828: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7902 - RNA, 1828 nt, synthetic construct
  misc_feature 1..1828: note = mRNA product Design i-3 comprising derived and/or modified sequence from HRSV(A2)__F_DSCav1_mut8 (opt1)
  source 1..1828: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtccacccccgtgaccctgagcaaggaccagctctccggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7903 - RNA, 1828 nt, synthetic construct
  misc_feature 1..1828: note = mRNA product Design i-3 comprising derived and/or modified sequence from HRSV(A2)__F_DSCav1_mut8 (opt2)
  source 1..1828: mol_type = other RNA
gggagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7904 - RNA, 1828 nt, synthetic construct
  misc_feature 1..1828: note = mRNA product Design i-3 comprising derived and/or modified sequence from HRSV(A2)__F_DSCav1_mut8 (opt3)
  source 1..1828: mol_type = other RNA
gggagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctcaacacccgtgaccctgagtaaagatcaactctctggaatcaataacattgctttcagcaattgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7905 - RNA, 1828 nt, synthetic construct
  misc_feature 1..1828: note = mRNA product Design i-3 comprising derived and/or modified sequence from HRSV(A2)__F_DSCav1_mut8 (opt4)
  source 1..1828: mol_type = other RNA
gggagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7906 - RNA, 1828 nt, synthetic construct
  misc_feature 1..1828: note = mRNA product Design i-3 comprising derived and/or modified sequence from HRSV(A2)__F_DSCav1_mut8 (opt5)
  source 1..1828: mol_type = other RNA
gggagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagaagcacacccgtgaccctttctaaagatcaactctccggcatcaataacatcgcgttcagcaattgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7907 - RNA, 1828 nt, synthetic construct
  misc_feature 1..1828: note = mRNA product Design i-3 comprising derived and/or modified sequence from HRSV(A2)__F_DSCav1_mut8 (opt6)
  source 1..1828: mol_type = other RNA
gggagaaagcttaccatggaactattaatattaaaagcaaacgcaatcacaactatactaacagcagtaacattctgctttgcctcaggtcaaaacataacagaggaattttaccaatccacatgctctgctgtaagcaaaggatacctcggagcattaagaactggatggtacacctcagtaataactatagaactatcaaacataaaagaaataaaatgtaatggcacagacgcaaaagtgaaattaatcaaacaagaactcgataaatacaaaaatgccgtaaccgatctccaacttttaatgcaaagcacacccgcaacaggttccgggtcagcaatagcaagcggagttgcagtatgcaaagtactacacttagaaggagaagtaaataaaatcaaatcagccttactatcaacaaataaagcagttgtatcactctcaggatgcggagtatccgtactaacatttaaagtactagatctaaaaaactacatagataaacaactcttaccaatactaaataaacaatcatgttccatacccaacatagaaaccgttatcgaatttcaacaaaaaaacaacagattactagaaatcacacgagaattttcagtaaatgctggagtcacaacaccagttagtacatacatgctcaccaattcagaactactaagtttaattaacgatatgccaataacaaacgaccaaaaaaaactaatgtcaaataacgtacaaatagtaagacaacaatcatactcaatcatgtgcataataaaagaagaagtactagcctatgtagtccaattaccactctacggcgtaatcgacaccccatgctggaaattacacacaagcccattatgcaccaccaacacaaaagaaggttcaaacatttgcttaaccagaaccgatcgaggatggtactgcgataacgcaggatctgtctcctttttcccacaagccgaaacatgcaaagttcaatcaaaccgagttttctgtgacactatgaactcactcacacttccaagcgaagtaaacctatgcaacgtagatatatttaaccctaaatacgactgcaaaataatgacaagcaaaacagacgttagttcatcagtaattacaagtctaggcgcaatagtgtcatgctacggaaaaacaaaatgcaccgcatccaataaatgccgaggaatcattaaaacattctcaaacggatgcgactacgtcagcaataaaggagtagacactgtttctgtaggaaacaccctatactatgtaaacaaacaagaaggtcaatcactatacgtaaagggagaaccaattataaatttttacgaccccttagtatttccaagtgatgaatttgacgcatctataagtcaagttaacgaaaaaattaaccaatcacttgcatttataagaaaatcagacgaactactccataatgtaaacgcaggtaaatcaacaacaaacatcatgatcacaaccataataatagtaataattgtaatattactatcactaatagcagtaggattactactctactgcaaagctagatctaccccggtcacactctcaaaagaccaattatctggaataaacaatatagcattcagcaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7908 - RNA, 1828 nt, synthetic construct
  misc_feature 1..1828: note = mRNA product Design i-3 comprising derived and/or modified sequence from HRSV(A2)__F_DSCav1_mut8 (opt11)
  source 1..1828: mol_type = other RNA
gggagaaagcttaccatggaactcctcatccttaaagccaacgccataaccaccatcctcaccgccgtcaccttctgcttcgcttctggccaaaacataaccgaagagttctaccaatccacgtgctctgccgtgtcaaaaggctacctcggagccctccgcacagggtggtacacttccgtcatcaccatcgaactctctaacatcaaagaaatcaagtgcaacggcacagacgcgaaagtcaagctcatcaaacaagaactagacaaatacaaaaacgccgtaacagacctccaactcctaatgcagtccacaccagccacaggctccggcagcgccatcgcctccggcgtcgctgtctgcaaagtcctacacctcgaaggcgaagtcaacaaaatcaagtcagccctccttagcaccaacaaagcagtcgtctctttaagcgggtgcggagtctctgtcctaacctttaaagtactcgacctcaaaaactacatcgacaaacaactactaccaatactaaacaaacagagctgctccattcccaacatcgaaaccgttatcgagttccaacaaaagaacaaccgcctcctcgaaatcacccgcgagttctccgtcaacgcaggcgtcaccaccccagtctccacctatatgctaaccaacagcgaactcctcagcctcatcaatgacatgccaatcaccaacgaccaaaagaaactcatgtccaacaacgtacagatagtccgccagcagtcctacagcatcatgtgcatcatcaaagaagaagtgctcgcctacgtggtacaactccctctctacggagtcattgatacaccctgctggaaactccacacaagccccctctgcactacaaacaccaaagaaggctctaacatatgcctcacccgcacagaccgtggttggtactgcgacaacgccggctccgtatccttctttccacaagctgaaacctgcaaagttcaatcaaaccgagtcttctgcgacaccatgaactccctcacattgcccagcgaagtcaacctctgcaacgtcgacatcttcaaccccaagtacgactgcaaaatcatgacctccaaaaccgacgtcagctccagcgtgatcacaagcctaggcgcgatcgtcagctgctacggcaaaaccaaatgcacagcctccaacaaatgccgcggaatcataaaaacattcagtaacggctgcgactacgtgtccaataaaggagtcgacaccgtatccgtcggaaacaccctctactacgtcaacaaacaagaaggacaatccctctatgtcaaaggcgaacccattatcaacttctacgaccccctagttttcccctccgacgagttcgacgcaagcatttcccaagtcaacgaaaagatcaatcaatccctcgccttcatacgcaaaagcgacgaactactacacaacgtaaacgccggcaaaagcaccaccaacatcatgatcacaacaatcatcatcgtcatcatcgtcatcctactctcactcatcgccgttggcctactactctactgcaaagcccgctccacacccgtcaccctctcaaaagaccaactctccggcatcaacaacatcgcattcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7909 - protein, 515 aa, synthetic construct
  REGION 1..515: note = derived and/or modified protein sequence (artificial) from HRSV(A2)__F-del_DSCav1_mut8
MELLILKANAITTILTAVTFCFASGQNITEEFYQSTCSAVSKGYLGALRTGWYTSVITIELSNIKEIKCNGTDAKVKLIKQELDKYKNAVTDLQLLMQSTPATGSGSAIASGVAVCKVLHLEGEVNKIKSALLSTNKAVVSLSGCGVSVLTFKVLDLKNYIDKQLLPILNKQSCSIPNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKCRGIIKTFSNGCDYVSNKGVDTVSVGNTLYYVNKQEGQSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 7910 - RNA, 1548 nt, synthetic construct
  misc_feature 1..1548: note = derived and/or modified CDS sequence (opt1) from HRSV(A2)__F-del_DSCav1_mut8
  source 1..1548: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtga

SEQ ID NO: 7911 - RNA, 1548 nt, synthetic construct
  misc_feature 1..1548: note = derived and/or modified CDS sequence (opt1) from HRSV(A2)__F-del_DSCav1_mut8
  source 1..1548: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtga

SEQ ID NO: 7912 - RNA, 1548 nt, synthetic construct
  misc_feature 1..1548: note = derived and/or modified CDS sequence (opt2) from HRSV(A2)__F-del_DSCav1_mut8
  source 1..1548: mol_type = other RNA
atggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctga

SEQ ID NO: 7913 - RNA, 1548 nt, synthetic construct
  misc_feature 1..1548: note = derived and/or modified CDS sequence (opt3) from HRSV(A2)__F-del_DSCav1_mut8
  source 1..1548: mol_type = other RNA
atggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctga

SEQ ID NO: 7914 - RNA, 1548 nt, synthetic construct
  misc_feature 1..1548: note = derived and/or modified CDS sequence (opt4) from HRSV(A2)__F-del_DSCav1_mut8
  source 1..1548: mol_type = other RNA
atggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatga

SEQ ID NO: 7915 - RNA, 1548 nt, synthetic construct
  misc_feature 1..1548: note = derived and/or modified CDS sequence (opt5) from HRSV(A2)__F-del_DSCav1_mut8
  source 1..1548: mol_type = other RNA
atggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatga

SEQ ID NO: 7916 - RNA, 1548 nt, synthetic construct
  misc_feature 1..1548: note = derived and/or modified CDS sequence (opt6) from HRSV(A2)__F-del_DSCav1_mut8
  source 1..1548: mol_type = other RNA
atggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataa

SEQ ID NO: 7917 - RNA, 1548 nt, synthetic construct
  misc_feature 1..1548: note = derived and/or modified CDS sequence (opt11) from HRSV(A2)__F-del_DSCav1_mut8
  source 1..1548: mol_type = other RNA
atggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataa

SEQ ID NO: 7918 - RNA, 1824 nt, synthetic construct
  misc_feature 1..1824: note = mRNA product Design a-1 comprising derived and/or modified sequence from HRSV(A2)__F-del_DSCav1_mut8 (opt1)
  source 1..1824: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7919 - RNA, 1824 nt, synthetic construct
  misc_feature 1..1824: note = mRNA product Design a-1 comprising derived and/or modified sequence from HRSV(A2)__F-del_DSCav1_mut8 (opt1)
  source 1..1824: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7920 - RNA, 1824 nt, synthetic construct
  misc_feature 1..1824: note = mRNA product Design a-1 comprising derived and/or modified sequence from HRSV(A2)__F-del_DSCav1_mut8 (opt2)
  source 1..1824: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7921 - RNA, 1824 nt, synthetic construct
  misc_feature 1..1824: note = mRNA product Design a-1 comprising derived and/or modified sequence from HRSV(A2)__F-del_DSCav1_mut8 (opt3)
  source 1..1824: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7922 - RNA, 1824 nt, synthetic construct
  misc_feature 1..1824: note = mRNA product Design a-1 comprising derived and/or modified sequence from HRSV(A2)__F-del_DSCav1_mut8 (opt4)
  source 1..1824: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7923 - RNA, 1824 nt, synthetic construct
  misc_feature 1..1824: note = mRNA product Design a-1 comprising derived and/or modified sequence from HRSV(A2)__F-del_DSCav1_mut8 (opt5)
  source 1..1824: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7924 - RNA, 1824 nt, synthetic construct
  misc_feature 1..1824: note = mRNA product Design a-1 comprising derived and/or modified sequence from HRSV(A2)__F-del_DSCav1_mut8 (opt6)
  source 1..1824: mol_type = other RNA
gggagagtcccgcagtcggcgtccagcggctctgcttgttcgtgtgtgtgtcgttgcaggccttattcaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7925 - RNA, 1824 nt, synthetic construct
  misc_feature 1..1824: note = mRNA product Design a-1 comprising derived and/or modified sequence from HRSV(A2)__F-del_DSCav1_mut8 (opt11)
  source 1..1824: mol_type = other RNA
gggagagtcccgcagtcggcgtccagcggctctgcttgttcgtgtgtgtgtcgttgcaggccttattcaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7926 - RNA, 1843 nt, synthetic construct
  misc_feature 1..1843: note = mRNA product Design a-2 comprising derived and/or modified sequence from HRSV(A2)__F-del_DSCav1_mut8 (opt1)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7927 - RNA, 1843 nt, synthetic construct
  misc_feature 1..1843: note = mRNA product Design a-2 comprising derived and/or modified sequence from HRSV(A2)__F-del_DSCav1_mut8 (opt1)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7928 - RNA, 1843 nt, synthetic construct
  misc_feature 1..1843: note = mRNA product Design a-2 comprising derived and/or modified sequence from HRSV(A2)__F-del_DSCav1_mut8 (opt2)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7929 - RNA, 1843 nt, synthetic construct
  misc_feature 1..1843: note = mRNA product Design a-2 comprising derived and/or modified sequence from HRSV(A2)__F-del_DSCav1_mut8 (opt3)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7930 - RNA, 1843 nt, synthetic construct
  misc_feature 1..1843: note = mRNA product Design a-2 comprising derived and/or modified sequence from HRSV(A2)__F-del_DSCav1_mut8 (opt4)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7931 - RNA, 1843 nt, synthetic construct
  misc_feature 1..1843: note = mRNA product Design a-2 comprising derived and/or modified sequence from HRSV(A2)__F-del_DSCav1_mut8 (opt5)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatcgccagcggggtcgcggtgtgtaaggttctccacctggagggagaggtgaataaaattaagtccgcccttctgagcaccaacaaagctgtcgtgtctctctccggctgcggcgttagcgtgctgacatttaaggtccttgatctgaagaattacatcgacaaacaactcctgcctattctgaacaagcagtcttgttccatcccgaatattgaaaccgtgatcgagttccagcagaaaaacaatcggctcctggaaatcacgcgcgagtttagcgtgaacgccggggtcacaacccccgtttctacatatatgcttaccaattccgagctgctcagcctgattaacgatatgcctatcaccaatgaccaaaagaaacttatgtccaacaacgtgcagattgtgagacagcagtcttacagcatcatgtgcattatcaaggaagaggtcctggcttatgtggttcaactccccctgtacggagtgatcgatacaccttgttggaaactgcatacgagccccctctgcaccacaaataccaaggaaggcagcaacatttgtctgacacggaccgaccgcgggtggtactgcgataatgccggatctgtctccttctttcctcaggcggagacgtgtaaggtgcagagcaacagagttttctgcgacacaatgaactctcttaccctgccgagcgaagtgaatctctgcaatgtcgatatctttaaccccaaatatgactgtaagattatgacctccaaaacagatgtgtctagctccgtcatcaccagcctgggcgccattgtgtcttgctacgggaagacaaaatgtacggcttccaataagtgccggggaatcatcaagaccttcagcaacggctgtgactatgtttctaataaaggcgtggacacagtctccgtggggaacaccctttactatgttaataagcaagagggacagagcctgtacgtgaaaggcgagcctattatcaacttttatgatcccctcgtcttcccttccgacgaatttgatgcctctattagccaggtgaatgagaagatcaaccagtccctggctttcattcgcaaatctgacgaactgctccacaacgtgaatgccgggaagtccacaaccaacatcatgattacgaccatcatcattgttatcattgtcatcctgctttccctgattgccgtgggactcctgctgtactgcaaggctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7932 - RNA, 1843 nt, synthetic construct
  misc_feature 1..1843: note = mRNA product Design a-2 comprising derived and/or modified sequence from HRSV(A2)__F-del_DSCav1_mut8 (opt6)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggaactactcatattgaaagccaacgcaatcacaacaatactaaccgccgtaacattttgcttcgcgtcaggccaaaatataacagaagaattttaccaatcaacatgctccgccgtatcaaaaggatacctaggtgcattacgaaccggttggtacacatcagtaatcacaatagaactttccaacattaaagaaataaaatgcaatggcacagacgcaaaagtcaaactaataaaacaagaactagacaaatataaaaacgccgtcacagacttacaactattaatgcaaagcacaccagcaacaggatccggatcagcaatagcatcaggagtagccgtctgtaaagtactacacctagaaggcgaagttaataaaattaaatcagctttattatcaaccaacaaagcagtagtatcactatccggatgcggagtctccgtcctaacattcaaagtactagacctcaagaattacatagataaacaactactaccaatactcaacaaacaatcatgttcaataccaaacatcgaaaccgtcatagaatttcaacaaaaaaataatagactcttagaaataacacgagaatttagcgtaaacgcaggagtcacaacccctgtctcaacatacatgctaaccaattccgaattattatcactcataaatgacatgccaataactaatgaccaaaaaaaacttatgtcaaacaacgtacaaatagtaagacaacaatcatattcaataatgtgcataatcaaagaagaagttttagcatatgtagtacaactaccactatatggcgtcatagacacaccatgctggaaattacacacatcacctctatgcacaacaaacacaaaagaaggaagcaacatttgcctaaccagaaccgatagaggatggtactgcgataacgcaggctcagtatcattcttccctcaagccgaaacttgcaaagtccaatcaaatagagtcttctgcgatacaatgaactccttaactttaccatcagaagtaaatctatgcaacgtagatatctttaatccaaaatacgattgcaaaatcatgacatcaaaaacagatgtatcatctagtgtaattacctccctaggagcaatagtaagctgctacggaaaaacaaaatgcaccgcctctaacaaatgtcgtggaataataaaaacattctcaaacggatgcgattatgtatcaaataaaggtgtcgacaccgtatcagtaggcaatacactatactatgtaaataaacaagaaggacaatcactctacgtcaaaggtgaaccaataataaacttctacgacccacttgtattcccaagcgacgaatttgacgcatcaataagccaagtaaacgaaaaaataaaccaatcactagcattcatcagaaaatcagacgaactactccacaatgtaaatgcaggaaaatcaacaaccaatatcatgataacaaccataataatagtcataatagtaatactattatccctcatagccgttggactactcctatattgtaaagcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7933 - RNA, 1843 nt, synthetic construct
  misc_feature 1..1843: note = mRNA product Design a-2 comprising derived and/or modified sequence from HRSV(A2)__F-del_DSCav1_mut8 (opt11)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgccatcaccaccatactcaccgcagtaaccttctgcttcgcatccggccaaaacatcacagaagagttctaccagagtacctgctccgccgtctccaaaggctaccttggcgccctccgtaccgggtggtacacatccgtcatcacaatcgaactctccaacatcaaagaaataaagtgcaacggcacagacgccaaagtaaaactgataaagcaagaactcgacaaatacaaaaacgccgtaaccgacctccagctactaatgcaatccactcccgccaccggcagcggatccgccatcgcctccggagtagccgtctgtaaagtcttacacctcgaaggcgaagtgaacaaaatcaaatccgccctactctcaaccaacaaagccgtagtatcactctccgggtgcggcgtttcagtgctaacgttcaaagtccttgacctcaaaaactacatcgacaaacaactcctccccatcctaaataaacaatcctgctccatacccaacatcgagactgtcatcgagttccagcagaaaaacaaccgactcctcgaaatcacacgcgagttctctgtcaacgccggcgtcacaacccccgtctccacatacatgctcaccaacagcgaactcctctccctaatcaatgacatgcccatcaccaacgaccaaaagaaactcatgtcaaacaacgtccaaatcgtccgccaacaatcctacagcatcatgtgcatcatcaaagaagaagttctcgcatacgtagtacaactccccctctacggagtgatcgacaccccctgctggaaactacacaccagcccgctttgcaccacaaacaccaaggaaggctccaacatctgcctcactcgaaccgaccgcggctggtactgcgacaacgcaggctccgtcagtttctttccccaagcagaaacatgcaaagtccaatccaaccgagtattctgcgacaccatgaactccctcaccctaccatccgaagttaacctatgcaacgtggacatcttcaaccccaagtacgactgcaaaattatgacctccaaaaccgacgtatcctccagcgtcatcaccagcctcggagcaatagtctcctgctacggcaagaccaagtgcaccgcttccaacaagtgtcgcggaatcatcaaaaccttctcaaacggctgcgactacgtctccaacaaaggcgtcgacaccgtatccgtaggaaacaccctatactacgtcaacaaacaagaaggacaatccctctatgtcaaaggcgaacccatcatcaatttctacgaccccctagtcttcccttccgacgagttcgacgcgtccatcagccaagtcaatgaaaagatcaaccagagcctggcattcatccgcaaatccgacgaactcctccacaacgtcaacgcgggaaaatccacgacaaacatcatgatcaccaccatcatcatcgtcatcatagtcattctcctttctctcatcgccgtgggactacttctctactgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7934 - RNA, 1921 nt, synthetic construct
  misc_feature 1..1921: note = mRNA product Design a-3 comprising derived and/or modified sequence from HRSV(A2)__F-del_DSCav1_mut8 (opt1)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7935 - RNA, 1921 nt, synthetic construct
  misc_feature 1..1921: note = mRNA product Design a-3 comprising derived and/or modified sequence from HRSV(A2)__F-del_DSCav1_mut8 (opt1)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatcgcctccggcgtggcggtgtgcaaggtcctgcacctcgagggggaggtgaacaagatcaagagcgccctgctgtccaccaacaaggccgtggtcagcctctccggctgcggggtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggcgtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggggtgatcgacacgccctgctggaagctgcacaccagccccctctgcaccaccaacacgaaggagggctccaacatctgcctgacccgcaccgaccggggctggtactgcgacaacgcggggtccgtgagcttcttcccccaggccgagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggcgccatcgtgtcctgctacgggaagaccaagtgcaccgccagcaacaagtgccggggcatcatcaagaccttctccaacggctgcgactacgtgagcaacaagggggtcgacacggtgtccgtgggcaacaccctctactacgtcaacaagcaggaggggcagagcctgtacgtgaagggcgagcccatcatcaacttctacgaccccctggtgttcccgagcgacgagttcgacgcctccatcagccaggtcaacgagaagatcaaccagtccctcgcgttcatccgcaagagcgacgagctgctgcacaacgtgaacgccgggaagtccaccaccaacatcatgatcaccacgatcatcatcgtgatcatcgtcatcctcctgagcctgatcgccgtgggcctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7936 - RNA, 1921 nt, synthetic construct
  misc_feature 1..1921: note = mRNA product Design a-3 comprising derived and/or modified sequence from HRSV(A2)__F-del_DSCav1_mut8 (opt2)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7937 - RNA, 1921 nt, synthetic construct
  misc_feature 1..1921: note = mRNA product Design a-3 comprising derived and/or modified sequence from HRSV(A2)__F-del_DSCav1_mut8 (opt3)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatcgcatcaggcgtggccgtctgtaaggtgttgcacctcgagggtgaggttaataaaattaagagcgctctgctgagtacgaacaaagccgtggtctccctctctgggtgcggagtgagcgtattaacttttaaggttctggatcttaagaattacatcgacaaacaattgctgcctattctaaacaagcagtcctgttcaatcccaaatatagaaaccgtgattgagttccagcagaaaaacaataggctcctggaaatcacacgggagtttagtgtcaacgcgggcgtgactaccccggtgagcacatatatgcttaccaattctgagctgttgtccctcattaacgatatgcccatcacgaatgaccaaaagaaactgatgtcaaacaacgtccagatcgttcgccagcagagctacagtattatgtgcataatcaaggaagaggtgttagcatatgtagtgcaactgcctctctacggcgtcattgatactccatgttggaaacttcatacatctcccctgtgcaccactaatacaaaggaagggtccaacatctgtttgacccgaacggaccgtggatggtactgcgataatgccggtagcgtgtcgttctttcctcaggctgagacctgtaaggttcagtctaacagagtgttctgcgacacaatgaactccctaactctgccatcagaagtcaatctctgcaatgtggatatatttaaccccaaatatgactgtaagattatgaccagtaaaacagatgtaagctcctctgttatcactagcctgggcgccatcgtgtcatgctacgggaagaccaaatgtacagcaagtaataagtgcaggggaattatcaagaccttctccaacggctgtgactatgtcagcaataaaggtgtggacactgtctctgtggggaacacgctttactatgttaataagcaagagggacagtcactgtacgtgaaaggcgagcctattataaacttttatgatccattggtattcccgagtgacgaatttgatgctagcatctcccaggtcaatgagaagattaaccagtctctcgccttcatccggaaatcggacgaactgttacacaacgtgaatgcgggcaagagcacaaccaacatcatgattactaccataatcattgttatcattgtgatcctgctatccctcatagccgtcgggctgcttttgtactgcaaggcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7938 - RNA, 1921 nt, synthetic construct
  misc_feature 1..1921: note = mRNA product Design a-3 comprising derived and/or modified sequence from HRSV(A2)__F-del_DSCav1_mut8 (opt4)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt
